US010480006B2

(12) United States Patent
Parks et al.

(10) Patent No.: US 10,480,006 B2
(45) Date of Patent: Nov. 19, 2019

(54) PESTICIDAL GENES AND METHODS OF USE

(71) Applicant: AgBiome, Inc., Research Triangle Park, NC (US)

(72) Inventors: Jessica Parks, Raleigh, NC (US); Kira Bulazel Roberts, Bahama, NC (US); Rebecca E. Thayer, Morrisville, NC (US)

(73) Assignee: AGBIOME, INC., Research Triangle Park, NC (US)

( * ) Notice: Subject to any disclaimer, the term of this patent is extended or adjusted under 35 U.S.C. 154(b) by 172 days.

(21) Appl. No.: 14/972,757

(22) Filed: Dec. 17, 2015

(65) Prior Publication Data

US 2016/0177333 A1   Jun. 23, 2016

Related U.S. Application Data

(60) Provisional application No. 62/095,524, filed on Dec. 22, 2014.

(51) Int. Cl.
| | | |
|---|---|---|
| *C12N 15/82* | (2006.01) | |
| *C07K 14/325* | (2006.01) | |
| *A01N 63/02* | (2006.01) | |

(52) U.S. Cl.
CPC ......... *C12N 15/8286* (2013.01); *A01N 63/02* (2013.01); *C07K 14/325* (2013.01); *Y02A 40/162* (2018.01)

(58) Field of Classification Search
None
See application file for complete search history.

(56) References Cited

U.S. PATENT DOCUMENTS

| | | | | |
|---|---|---|---|---|
| 5,380,831 | A * | 1/1995 | Adang | C07K 14/325 435/69.1 |
| 7,022,899 | B2 | 4/2006 | Suttner et al. | |
| 8,318,900 | B2 | 11/2012 | Sampson et al. | |
| 8,461,421 | B2 * | 6/2013 | Sampson | C07K 14/325 435/252.3 |
| 8,691,727 | B2 | 4/2014 | Zeun et al. | |
| 2008/0072494 | A1 | 3/2008 | Stoner et al. | |
| 2010/0005543 | A1 | 1/2010 | Sampson et al. | |
| 2011/0203014 | A1 * | 8/2011 | Sampson | A01N 37/46 800/279 |
| 2012/0304337 | A1 | 11/2012 | Schellenberger et al. | |

FOREIGN PATENT DOCUMENTS

| | | |
|---|---|---|
| EA | 018690 | 9/2013 |
| RU | 2129373 | 4/1999 |
| WO | 9204453 | 3/1992 |
| WO | 2007/147029 A2 | 12/2007 |
| WO | WO 2007/147029 | 12/2007 |
| WO | 2009/099602 A1 | 8/2009 |
| WO | WO 2009/099602 | 8/2009 |
| WO | 2011/084314 A2 | 7/2011 |
| WO | WO 2011/084314 | 7/2011 |
| WO | 2013/134734 A2 | 9/2013 |
| WO | WO 2013/134734 | 9/2013 |
| WO | 2014/138339 | 9/2014 |

OTHER PUBLICATIONS de Maagd et al., Trends Genet 17: 193-199 (2001).*
Palma et al., Toxins 6:3296-325 (2014.*
Aronson & Shai, FEMS Microbiol Lett 195:1-8 (2001).*
Berry & Crickmore, J Invert Path 142:16-22, 17 (2017).*
Pardo-Lopez et al., Peptides 30:589-95 (2009).*
Murray et al., Plant Mol Biol 16:1035-50 (1991).*
Herrero et al., Biochem. J. 384:507-513 (2004).*
Abdul-Rauf & Ellar, Curr. Microbiol. 39:94-98 (1999).*
Caruccio, Nicholas, "Preparation of next-generation sequencing libraries using Nextera™ technology: simultaneous DNA fragmentation and adaptor tagging by in vitro transposition," Methods Mol. Biol. 733(1):241-255 (2011).
Glenn, Travis C., "Field guide to next-generation DNA sequencers," Mol. Ecol. Resources 11(5):759-769 (2011).
International Application No. PCT/US2015/066314, International Search Report and Written Opinion, dated Jun. 17, 2016.
EMBL-EBI European Nucleotide Archive Accession No. BAH88460, "*Streptococcus* mutans NN2025 putative tryptophan synthase beta subunit," Mar. 18, 2008.
EMBL-EBI European Nucleotide Archive Accession No. BAH88459, "*Streptococcus* mutans NN2025 putative tryptophan synthase alpha subunit," Mar. 18, 2008.
EMBL-EBI European Nucleotide Archive Accession No. BAT11479, "*Oryza saliva* Japonica Group (Japanese rice) hypothetical protein," Oct. 9, 2015.
EMBL-EBI European Nucleotide Archive Accession No. GN010323—Search Result obtained Oct. 23, 2016.

(Continued)

*Primary Examiner* — Russell T Boggs
(74) *Attorney, Agent, or Firm* — Kilpatrick Townsend & Stockton LLP

(57) ABSTRACT

Compositions having pesticidal activity and methods for their use are provided. Compositions include isolated and recombinant polypeptides having pesticidal activity, recombinant and synthetic nucleic acid molecules encoding the polypeptides, DNA constructs and vectors comprising the nucleic acid molecules, host cells comprising the vectors, and antibodies to the polypeptides. Polynucleotide sequences encoding the polypeptides can be used in DNA constructs or expression cassettes for transformation and expression in organisms of interest. The compositions and methods provided are useful for producing organisms with enhanced pest resistance or tolerance. Transgenic plants and seeds comprising a nucleotide sequence that encodes a pesticidal protein of the invention are also provided. Such plants are resistant to insects and other pests. Methods are provided for producing the various polypeptides disclosed herein, and for using those polypeptides for controlling or killing a pest. Methods and kits for detecting polypeptides of the invention in a sample are also included.

39 Claims, 14 Drawing Sheets

Specification includes a Sequence Listing.

(56) References Cited

OTHER PUBLICATIONS

GenBank Accession No. ABC17640.2, "Cytolytic toxin Cyt1 [Bacillus thuringiensis]"; Aug. 11, 2006; via internet https://www.ncbi.nlm.nih.gov/protein/ABC17640.2 as accessed Sep. 1, 2017.

GenBank Accession No. AGU13868.1, "Pesticidal protein [Bacillus thuringiensis]"; Nov. 14, 2013; via internet https://www.ncbi.nlm.nih.gov/protein/AGU13868.1 as accessed Sep. 1, 2017.

Caruccio, N.; "Preparation of next-generation sequencing libraries using Nextera(TM) technology: simultaneous DNA fragmentation and adaptor tagging by in vitro transposition"; Methods in Molecular Biology, Humana Press, Inc. US; Jan. 1, 2011; vol. 733; pp. 241-255.

Glenn, T.; "Field guide to next-generation DNA sequencers"; Molecular Ecology Resources; May 19, 2011; vol. 11, No. 5; pp. 759-769.

Patent Cooperation Treaty Application No. PCT/US20150/66314, International Search Report and Written Opinion dated Jun. 17, 2016.

GenBank Accession No. ADK66923.1, "Cry32 [Bacillus thuringiensis]"; Dec. 31, 2012, via internet at https://www.ncbi.nlm.nih.gov/protein/ADK66923.1.

Pakula et al., "Genetic Analysis of Protein Stability and Function", Annual Reviews of Genetics, vol. 23, 1989, pp. 289-310.

\* cited by examiner

Increasing size phenotype →

| | b | m.b | s.b | s.m.b | s.m | s |
|---|---|---|---|---|---|---|
| 0-50% | - | - | - | - | +/- | +/- |
| 50-80% | - | - | - | +/- | +/- | +/- |
| 80-100% | +/- | +/- | +/- | +/- | + | + |

Increasing mortality ↓

Figure 7

PESTICIDAL GENES AND METHODS OF USE

CROSS REFERENCE TO RELATED APPLICATION

This application claims the benefit of U.S. Provisional Application Ser. No. 62/095,524, filed Dec. 22, 2014, the contents of this application is herein incorporated by reference in their entirety.

FIELD OF THE INVENTION

The invention is drawn to methods and compositions for controlling pests, particularly plant pests.

REFERENCE TO A SEQUENCE LISTING SUBMITTED AS A TEXT FILE VIA EFS-WEB

The official copy of the sequence listing is submitted electronically via EFS-Web as an ASCII formatted sequence listing with a file named AgB006.US_SEQLIST.txt, created on Dec. 14, 2015 and having a size of 956 KB and is filed concurrently with the specification. The sequence listing contained in this ASCII formatted document is part of the specification and is herein incorporated by reference in its entirety.

BACKGROUND

Pests, plant diseases, and weeds can be serious threats to crops. Losses due to pests and diseases have been estimated at 37% of the agricultural production worldwide, with 13% due to insects, bacteria and other organisms.

Toxins are virulence determinants that play an important role in microbial pathogenicity and/or evasion of the host immune response. Toxins from the gram-positive bacterium *Bacillus*, particularly *Bacillus thuringensis*, have been used as insecticidal proteins (commonly referred to as Bt toxins). Current strategies use the genes expressing these toxins to produce transgenic crops. Transgenic crops expressing insecticidal protein toxins are used to combat crop damage from insects.

While the use of *Bacillus* toxins has been successful in controlling insects, resistance to Bt toxins has developed in some target pests in many parts of the world where such toxins have been used intensively. One way of solving this problem is sowing Bt crops with alternating rows of regular non Bt crops (refuge). An alternative method to avoid or slow down development of insect resistance is stacking insecticidal genes with different modes of action against insects in transgenic plants. The current strategy of using transgenic crops expressing insecticidal protein toxins is placing increasing emphasis on the discovery of novel toxins, beyond those already derived from the bacterium *B. thuringiensis*. Novel toxins may prove useful as alternatives to those derived from *B. thuringiensis* for deployment in insect- and pest-resistant transgenic plants. Thus, new toxin proteins are needed.

BRIEF DESCRIPTION OF THE FIGURES

FIG. 1 provides an amino acid alignment of SEQ ID NOs: 8, 9, 123, and 124. Highlighted regions denote regions where the amino acids are different between the four polypeptides.

FIG. 2 provides an amino acid alignment of SEQ ID NOs: 25, 26, 125 and 126. Highlighted regions denote regions where the amino acids are different between the four polypeptides.

FIG. 3 provides an amino acid alignment of SEQ ID NOs: 72, 94, 127, and 128. Highlighted regions denote regions where the amino acids are different between the four polypeptides.

FIG. 4 provides an amino acid alignment of SEQ ID NOs: 70, 71, 129, 130 and 131. Highlighted regions denote regions where the amino acids are different between the five polypeptides.

Figure 5B:
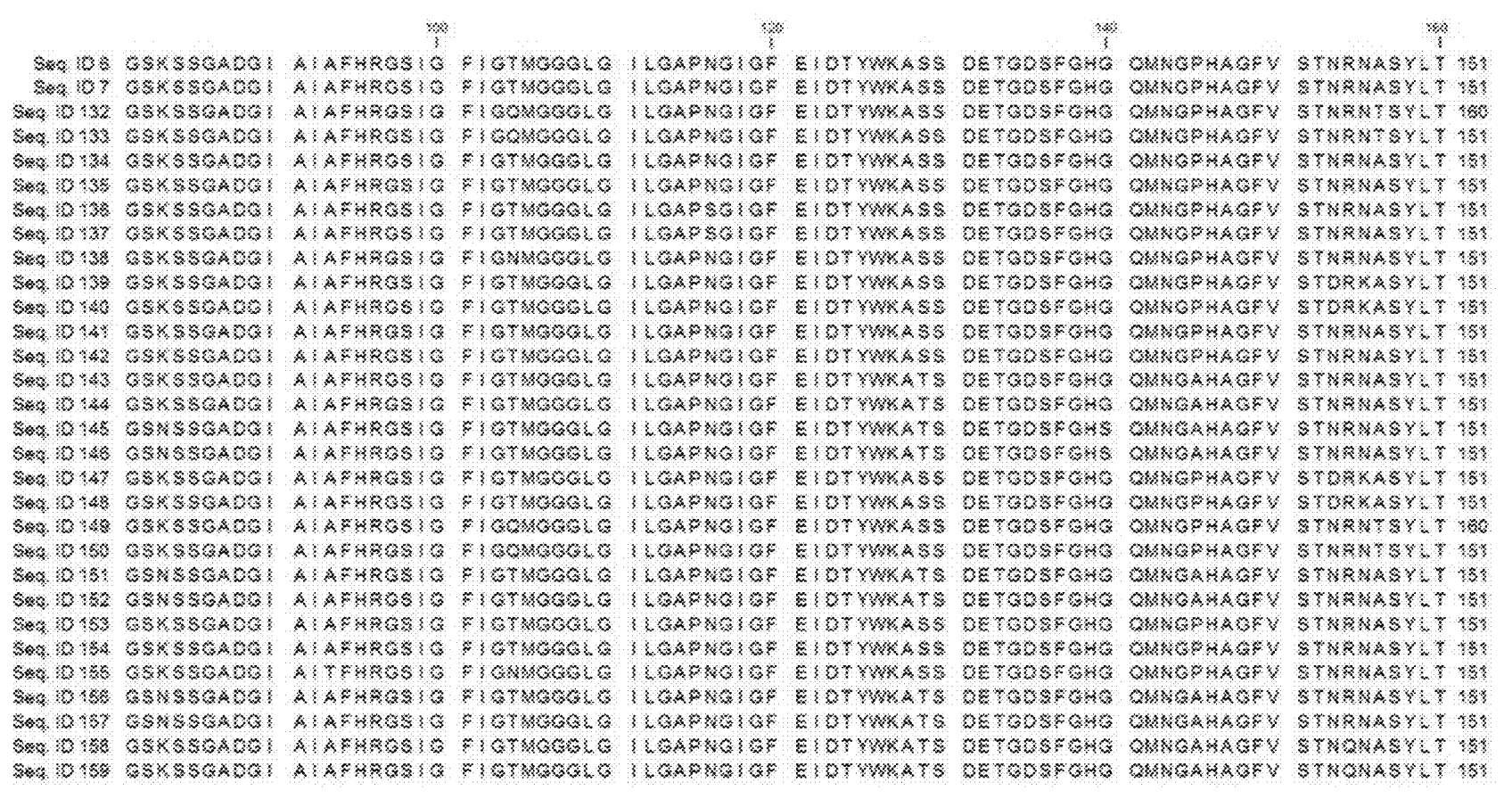

FIGS. 5A-5H provide an amino acid alignment of SEQ ID NOs: 6, 7, 132, 133, 134, 135, 136, 137, 138, 139, 140, 141, 142, 143, 144, 145, 146, 147, 148, 149, 150, 151, 152, 153, 154, 155, 156, 157, 158, and 159. Highlighted regions denote regions conserved in each of the polypeptides. Conserved regions present in this alignment are set forth in Table 4.

FIG. 6 provides the percent sequence identity relationship of each of SEQ ID NOs: 6 and 132-159.

FIG. 7 provides the assay scoring guidelines (size x mortality matrix) employed in the western corn rootworm bioassay.

SUMMARY

Figure 5A:
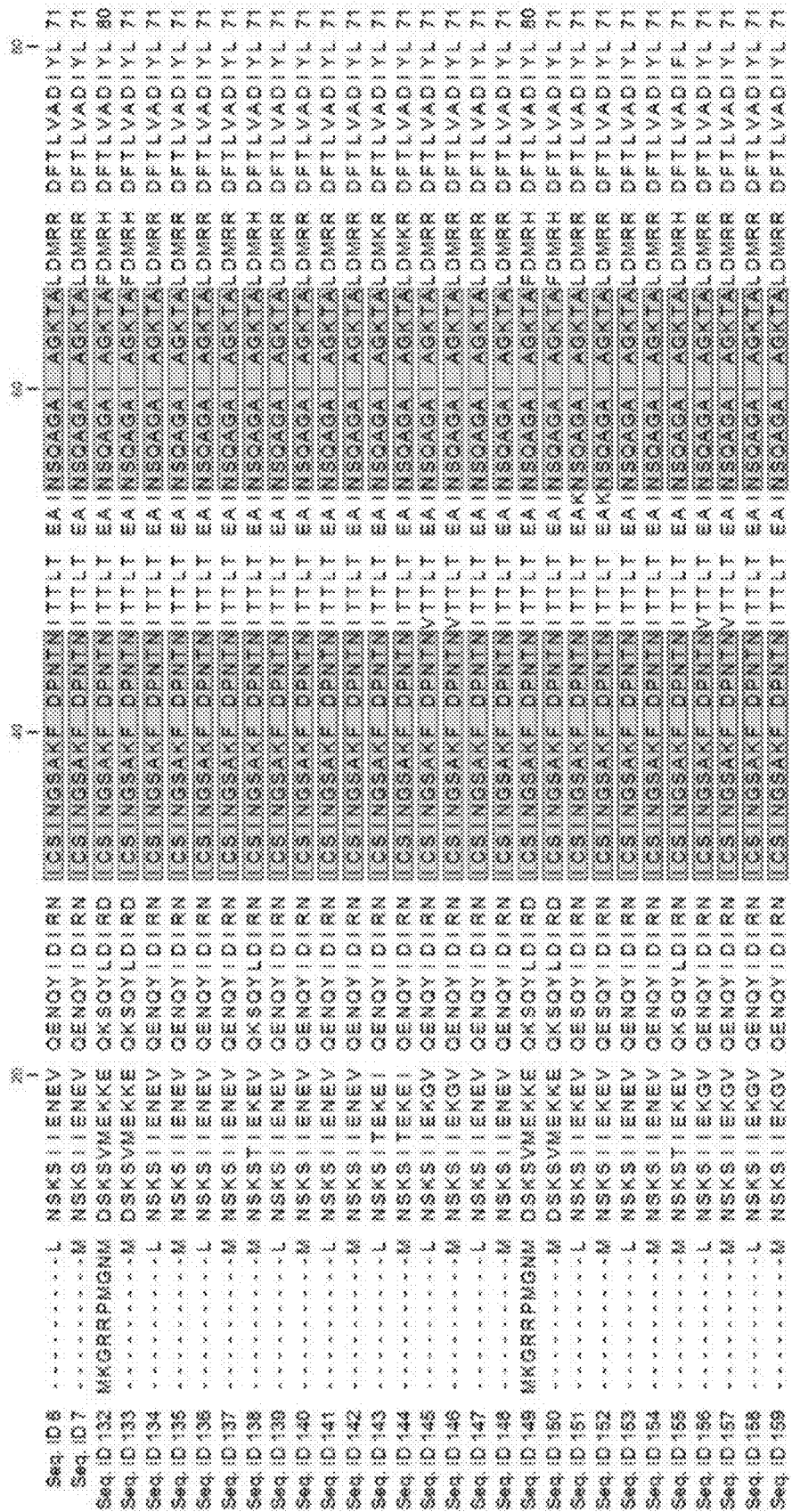

Compositions having pesticidal activity and methods for their use are provided. Compositions include isolated and recombinant polypeptide sequences having pesticidal activity, recombinant and synthetic nucleic acid molecules encoding the pesticidal polypeptides, DNA constructs comprising the nucleic acid molecules, vectors comprising the nucleic acid molecules, host cells comprising the vectors, and antibodies to the pesticidal polypeptides. Nucleotide sequences encoding the polypeptides provided herein can be used in DNA constructs or expression cassettes for transformation and expression in organisms of interest, including microorganisms and plants.

The compositions and methods provided herein are useful for the production of organisms with enhanced pest resistance or tolerance. These organisms and compositions comprising the organisms are desirable for agricultural purposes. Transgenic plants and seeds comprising a nucleotide sequence that encodes a pesticidal protein of the invention are also provided. Such plants are resistant to insects and other pests.

Methods are provided for producing the various polypeptides disclosed herein, and for using those polypeptides for controlling or killing a pest. Methods and kits for detecting polypeptides of the invention in a sample are also included.

DETAILED DESCRIPTION

The present inventions now will be described more fully hereinafter with reference to the accompanying drawings, in which some, but not all embodiments of the inventions are shown. Indeed, these inventions may be embodied in many different forms and should not be construed as limited to the embodiments set forth herein; rather, these embodiments are provided so that this disclosure will satisfy applicable legal requirements. Like numbers refer to like elements throughout.

Many modifications and other embodiments of the inventions set forth herein will come to mind to one skilled in the art to which these inventions pertain having the benefit of the teachings presented in the foregoing descriptions and the associated drawings. Therefore, it is to be understood that the inventions are not to be limited to the specific embodiments disclosed and that modifications and other embodiments are intended to be included within the scope of the appended claims. Although specific terms are employed herein, they are used in a generic and descriptive sense only and not for purposes of limitation.

I. Polynucleotides and Polypeptides

Compositions and method for conferring pesticidal activity to an organism are provided. The modified organism exhibits resistance or tolerance to pests. Recombinant pesticidal proteins, or polypeptides and fragments and variants thereof that retain pesticidal activity, are provided and include those set forth in SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, and/or 159. The pesticidal proteins are biologically active (for example, are pesticidal) against pests including insects, fungi, nematodes, and the like. Polynucleotides encoding the pesticidal polypeptides, including for example, SEQ ID NOS: 1-159 or active fragments or variants thereof, can be used to produce transgenic organisms, such as plants and microorganisms. The transformed organisms are characterized by genomes that comprise at least one stably incorporated DNA construct comprising a coding sequence for a pesticidal protein disclosed herein. In some embodiments, the coding sequence is operably linked to a promoter that drives expression of the encoded pesticidal polypeptide. Accordingly, transformed microorganisms, plant cells, plant tissues, plants, seeds, and plant parts are provided. A summary of various polypeptides, active variants and fragments thereof, and polynucleotides encoding the same are set forth below in Table 1. As noted in Table 1, various forms of polypeptides are provided. Full length pesticidal polypeptides, as well as, modified versions of the original full-length sequence (referred to as variants) are provided. Table 1 further denotes "CryBP1" sequences. Such sequences (SEQ ID NOs: 24, 67 and 73) comprise accessory polypeptides that can be associated with some of the toxin genes. In such instances, the CryBP1 sequences can be used alone or in combination with any of the pesticidal polypeptides provided herein. Table 1 further provides Split-Cry C'-terminus polypeptides (SEQ ID NOs: 3, 74, 77, 80 and 91). Such sequences comprise the sequence of a downstream protein that has homology to the C'-terminal end of the Cry class of toxin genes and are usually found after a Cry gene that is not full-length and is missing the expected C'-terminal region.

TABLE 1

Summary of SEQ ID NOs, Gene Class, and Variants Thereof

| Gene Name | Full-length SEQ ID No. | Variant SEQ ID No.(s) | Cry-BP1 SEQ ID No. | Split-CryC-terminus SEQ ID No. | Homologs | Gene Class | Polypeptides of the invention (and polynucleotides encoding the same) include those having the % sequence identity listed below | Polypeptides of the invention (and polynucleotides encoding the same) include those having the similarity set forth below |
|---|---|---|---|---|---|---|---|---|
| APG00002 | 1 | 2, 95, 96 | | 3 | APG00034 (60.3% identity, 70.6% similarity) APG00101 (46.6% identity, 61.8% similarity) APG00048 (41.5% identity, 56.6% similarity) Cry13Aa1 (35.6% identity, 51.6% similarity) US_7923602_B2-12 (34.2% identity, 49.8% similarity) | Cry | 40, 45, 50, 55, 60, 65, 70, 75, 80, 85, 90, 95, 96, 97, 98, 99 | 55, 60, 65, 70, 75, 80, 85, 90, 95, 96, 97, 98, 99 |
| APG00005 | 4 | 5 | | | US_8461415_B2-28 (29.5% identity, 44.0% similarity) US_8318900_B2-83 (28.8% identity, 44.6% similarity) Cry54Aa2 (28.7% identity, 44.4% similarity) US_8318900_B2-80 (28.2% identity, 43.4% similarity) WP_016099738.1 (27.8% identity, 45.7% similarity) | Cry | 30, 35, 40, 45, 50, 55, 60, 65, 70, 75, 80, 85, 90, 95, 96, 97, 98, 99 | 50, 55, 60, 65, 70, 75, 80, 85, 90, 95, 96, 97, 98, 99 |
| APG00008 | 6 | 7, 132-159 | | | WP_002169786.1 (95.1% identity, 97.3% similarity) US_7208656_B2-8 (94.8% identity, 97.5% similarity) Cry22Ba1 (94.6% identity, 97.5% similarity) US_8461421_B2-109 (94.1% identity, 96.8% similarity) Cry22Bb1 (94.0% identity, 96.8% similarity) | Cry22B | 96, 97, 98, 99 | 98, 99 |

TABLE 1-continued

Summary of SEQ ID NOs, Gene Class, and Variants Thereof

| Gene Name | Full-length SEQ ID No. | Variant SEQID No.(s) | Cry-BP1 SEQ ID No. | Split-CryC-terminus SEQ ID No. | Homologs | Gene Class | Polypeptides of the invention (and polynucleotides encoding the same) include those having the % sequence identity list TABLE 1-continued Summary of SEQ ID NOs, Gene Class, and Variants Thereof

| Gene Name | Full-length SEQ ID No. | Variant SEQ ID No.(s) | Cry-BP1 SEQ ID No. | Split-CryC-terminus SEQ ID No. | Homologs | Gene Class | Polypeptides of the invention (and polynucleotides encoding the same) include those having the % sequence identity listed below | Polypeptides of the invention (and polynucleotides encoding the same) include those having the similarity set forth below |
|---|---|---|---|---|---|---|---|---|
| APG00 059 | 27 | 28, 101, 102 | | | US_8147856_B2-33 (89.2% identity, 95.0% similarity) US_7923602_B2-38 (87.0% identity, 92.8% similarity) Cry14Aa1 (84.0% identity, 90.4% similarity) US_7919272_B2-13 (66.9% identity, 77.8% similarity) WP_016084446.1 (65.1% identity, 74.2% similarity) WP_016085042.1 (63.5% identity, 73.9% similarity) WP_016084057.1 (63.4% identity, 73.8% similarity) APG00079 (63.3% identity, 73.0% similarity) Cry69Aa1 (57.0% identity, 68.3% similarity) | Cry69 | 70, 75, 80, 85, 90, 95, 96, 97, 98, 99 | 80, 85, 90, 95, 96, 97, 98, 99 |
| APG00 062 | 29 | 30 | | | APG00094 (57.7% identity, 70.8% similarity) WP_002187556.1 (33.1% identity, 47.7% similarity) US_20130227743_A1-32 (32.1% identity, 49.9% similarity) APG00130 (32.1% identity, 49.4% similarity) Cry73Aa (30.4% identity, 45.1% similarity) | Cry | 35, 40, 45, 50, 55, 60, 65, 70, 75, 80, 85, 90, 95, 96, 97, 98, 99 | 50, 55, 60, 65, 70, 75, 80, 85, 90, 95, 96, 97, 98, 99 |
| APG00 065 | 31 | 32 | | | WP_000839920.1 (71.3% identity, 80.0% similarity) WP_002166959.1 (71.2% identity, 80.5% similarity) WP_002191947.1 (71.0% identity, 80.5% similarity) US_8318900_B2-72 (68.3% identity, 76.8% similarity) US_20130227743_A1-146 (68.1% identity, 76.6% similarity) | Bin | 75, 80, 85, 90, 95, 96, 97, 98, 99 | 85, 90, 95, 96, 97, 98, 99 |
| APG00 066 | 33 | 34, 103 | | | US_6063597_A-51.1 (29.3% identity, 46.8% similarity) Cry29Aa1 (29.3% identity, 44.4% similarity) US7521235B2_2 (27.6% identity, 43.5% similarity) WP_016098322.1 (27.3% identity, 43.6% similarity) AGV55018.1 (26.0% identity, 40.6% similarity) | Cry | 30, 35, 40, 45, 50, 55, 60, 65, 70, 75, 80, 85, 90, 95, 96, 97, 98, 99 | 50, 55, 60, 65, 70, 75, 80, 85, 90, 95, 96, 97, 98, 99 |
| APG00 068 | 35 | 36 | | | US_8318900_B2-82 (63.5% identity, 74.6% similarity) Cry32Ea1 (63.2% identity, 74.2% similarity) US_8461421_B2-91 (62.1% identity, 72.8% similarity) US_8461421_B2-99 (61.9% identity, 74.4% similarity) AGU13868.1 (60.4% identity, 72.5% similarity) | Cry32 | 65, 70, 75, 80, 85, 90, 95, 96, 97, 98, 99 | 75, 80, 85, 90, 95, 96, 97, 98, 99 |

TABLE 1-continued

Summary of SEQ ID NOs, Gene Class, and Variants Thereof

| Gene Name | Full-length SEQ ID No. | Variant SEQID No.(s) | Cry-BP1 SEQ ID No. | Split-CryC-terminus SEQ ID No. | Homologs | Gene Class | Polypeptides of the invention (and polynucleotides encoding the same) include those having the % sequence identity list TABLE 1-continued Summary of SEQ ID NOs, Gene Class, and Variants Thereof

| Gene Name | Full-length SEQ ID No. | Variant SEQ ID No.(s) | Cry-BP1 SEQ ID No. | Split-CryC-terminus SEQ ID No. | Homologs | Gene Class | Polypeptides of the invention (and polynucleotides encoding the same) include those having the % sequence identity list TABLE 1-continued Summary of SEQ ID NOs, Gene Class, and Variants Thereof

| Gene Name | Full-length SEQ ID No. | Variant SEQ ID No.(s) | Cry-BP1 SEQ ID No. | Split-CryC-terminus SEQ ID No. | Homologs | Gene Class | Polypeptides of the invention (and polynucleotides encoding the same) include those having the % sequence identity list TABLE 1-continued Summary of SEQ ID NOs, Gene Class, and Variants Thereof

| Gene Name | Full-length SEQ ID No. | Variant SEQID No.(s) | Cry-BP 1 SEQ ID No. | Split-CryC-terminus SEQ ID No. | Homologs | Gene Class | Polypeptides of the invention (and polynucleotides encoding the same) include those having the % sequence identity listed below | Polypeptides of the invention (and polynucleotides encoding the same) include those having the similarity set forth below |
|---|---|---|---|---|---|---|---|---|
| APG00 115 | 65 | 66, 115, 116 | | 67 | US_8318900_B2-205 (18.9% identity, 31.5% similarity) WP_002147758.1 (18.8% identity, 31.5% similarity) WP_002069902.1 (18.7% identity, 31.3% similarity) WP_002205004.1 (56.7% identity, 67.4% similarity) US_8461421_B2-83 (54.8% identity, 64.1% similarity) US_8461421_B2-75 (53.2% identity, 62.4% similarity) US_8461421_B2-104 (45.1% identity, 56.5% similarity) WP_002187573.1 (45.0% identity, 53.2% similarity) US_8318900_B2-61 (42.5% identity, 56.5% similarity) US_8461421_B2-92 (40.4% identity, 53.7% similarity) APG00068 (35.5% identity, 48.1% similarity) WP_002187555.1 (34.2% identity, 37.2% similarity) WP_002187592.1 (33.7% identity, 37.8% similarity) | Cry | 60, 65, 70, 75, 80, 85, 90, 95, 96, 97, 98, 99 | 70, 75, 80, 85, 90, 95, 96, 97, 98, 99 |
| APG00 120 | 68 | 69, 117, 118 | | | Cry41Ba2 (44.1% identity, 58.6% similarity) Cry41Aa1 (39.5% identity, 54.4% similarity) Cry41Ab1 (37.0% identity, 52.7% similarity) US_8461421_B2-94 (36.7% identity, 51.7% similarity) WP_002169796.1 (35.3% identity, 49.3% similarity) | Cry | 45, 50, 55, 60, 65, 70, 75, 80, 85, 90, 95, 96, 97, 98, 99 | 60, 65, 70,75, 80, 85, 90, 95, 96, 97, 98,99 |
| APG00 124 | 70 | 71, 129, 130, 131, | | | US_8461421_B2-99 (43.9% identity, 54.4% similarity) Cry32Ea1 (43.2% identity, 53.9% similarity) AGU13868.1 (43.1% identity, 53.7% similarity) APG00068 (42.4% identity, 53.1% similarity) Cry32Ab1 (41.8% identity, 52.0% similarity) | Cry | 45, 50, 55, 60, 65, 70, 75, 80, 85, 90, 95, 96, 97, 98, 99 | 55, 60, 65,70, 75, 80, 85, 90, 95, 96, 97,98, 99 |
| APG00 130 | 72 | 127, 128, 94 | 73 | 74 | WP_002187593.1 (63.8% identity, 69.4% similarity) US_8461421_B2-84 (61.2% identity, 67.1% similarity) Cry73Aa (60.6% identity, 66.5% similarity) APG00140 (47.7% identity, 57.4% similarity) AHN52957.1 (46.8% identity, 57.4% similarity) | Cry73 | 65, 70, 75, 80, 85, 90, 95, 96, 97, 98, 99 | 70, 75, 80,85, 90, 95, 96, 97, 98, 99 |
| APG00 136 | 75 | 76 | | 77 | Cry65Aa2 (52.6% identity, 61.0% similarity) US_8461421_B2-94 (24.8% identity, 38.3% similarity) | Cry65 | 55, 60, 65, 70, 75, 80, 85, 90, 95, 96, 97, 98, 99 | 65, 70, 75,80, 85, 90, 95, 96, 97, 98, 99 |

TABLE 1-continued

Summary of SEQ ID NOs, Gene Class, and Variants Thereof

| Gene Name | Full-length SEQ ID No. | Variant SEQ ID No.(s) | Cry-BP1 SEQ ID No. | Split-CryC-terminus SEQ ID No. | Homologs | Gene Class | Polypeptides of the invention (and polynucleotides encoding the same) include those

TABLE 1-continued

Summary of SEQ ID NOs, Gene Class, and Variants Thereof

| Gene Name | Full-length SEQ ID No. | Variant SEQID No.(s) | Cry-BP1 SEQ ID No. | Split-CryC-terminus SEQ ID No. | Homologs | Gene Class | Polypeptides of the invention (and polynucleotides encoding the same) include those having the % sequence ident lifesci.sussex.ac.uk/home/Neil_Crickmore/Bt/). The majority of the *B. thuringiensis* isolates with cyt genes show activity against dipteran insects (particularly mosquitoes and black flies), but there are also cyt genes that have been described in *B. thuringiensis* strains targeting lepidopteran or coleopteran insects (Guerchicoff et al. (1997) *Appl. Environ. Microbiol.* 63: 2716-2721).

The structure of Cyt2A, solved by X-ray crystallography, shows a single domain where two outer layers of α-helix wrap around a mixed β-sheet. Further available crystal structures of Cyt toxins support a conserved α-β structural model with two α-helix hairpins flanking a β-sheet core containing seven to eight β-strands. (Cohen et al. (2011) *J. Mol. Biol.* 413: 80 4-814) Mutagenic studies identified β-sheet residues as critical for toxicity, while mutations in the helical domains did not affect toxicity (Adang et al.; Diversity of *Bacillus thuringiensis* Crystal Toxins and Mechanism of Action. In: T. S. Dhadialla and S. S. Gill, eds, *Advances in Insect Physiology*, Vol. 47, Oxford: Academic Press, 2014, pp. 39-87.) The representative domain of the Cyt toxin is a δ-endotoxin, Bac_thur_toxin (Pfam PF01338).

There are multiple proposed models for the mode of action of Cyt toxins, and it is still an area of active investigation. Some Cyt proteins (Cyt1A) have been shown to require the presence of accessory proteins for crystallization. Cyt1A and Cyt2A protoxins are processed by digestive proteases at the same sites in the N- and C-termini to a stable toxin core. Cyt toxins then interact with non-saturated membrane lipids, such as phosphatidylcholine, phosphatidylethanolamine, and sphingomyelin. For Cyt toxins, pore-formation and detergent-like membrane disruption have been proposed as non-exclusive mechanisms; and it is generally accepted that both may occur depending on toxin concentration, with lower concentrations favoring oligomeric pores and higher concentrations leading to membrane breaks. (Butko (2003) *Appl. Environ. Microbiol.* 69: 2415-2422) In the pore-formation model, the Cyt toxin binds to the cell membrane, inducing the formation of cation-selective channels in the membrane vesicles leading to colloid-osmotic lysis of the cell. (Knowles et al. (1989) *FEBS Lett.* 244: 259-262; Knowles et al. (1992) *Proc. R. Soc. Ser. B.* 248: 1-7 and Promdonkoy et al. (2003) *Biochem. J.* 374: 255-259). In the detergent model, there is a nonspecific aggregation of the toxin on the surface of the lipid bilayer leading to membrane disassembly and cell death. (Butko (2003) supra; Manceva et al. (2005) *Biochem.* 44: 589-597).

Multiple studies have shown synergistic activity between Cyt toxins and other *B. thuringiensis* toxins, particularly the Cry, Bin, and Mtx toxins. This synergism has even been shown to overcome an insect's resistance to the other toxin. (Wirth 1997, Wirth 2005, Thiery 1998, Zhang 2006) The Cyt synergistic effect for Cry toxins is proposed to involve Cyt1A binding to domain II of Cry toxins in solution or on the membrane plane to promote formation of a Cry toxin pre-pore oligomer. Formation of this oligomer is independent of the Cyt oligomerization, binding or insertion. (Lailak 2013, Perez 2007, Lopez-Diaz 2013)

A number of pesticidal proteins unrelated to the Cry proteins are produced by some strains of *B. thuringiensis* and *B. cereus* during vegetative growth (Estruch et al. (1996) *Proc Natl Acad Sci USA* 93:5389-5394; Warren et al. (1994) WO 94/21795). These vegetative insecticidal proteins, or Vips, do not form parasporal crystal proteins and are apparently secreted from the cell. The Vips are presently excluded from the Cry protein nomenclature because they are not crystal-forming proteins. The term VIP is a misnomer in the sense that some *B. thuringiensis* Cry proteins are also produced during vegetative growth as well as during the stationary and sporulation phases, most notably Cry3Aa. The location of the Vip genes in the *B. thuringiensis* genome has been reported to reside on large plasmids that also encode cry genes (Mesrati et al. (2005) *FEMS Microbiol. Lett.* 244(2):353-8), A web-site for the nomenclature of Bt toxins can be found on the World Wide Web at lifesci.sussex.ac.uk with the path "/home/Neil_Crickmore/Bt/" and at: "btnomenclature.info/". See also, Schnepf et al. (1998) *Microbiol. Mol. Biol. Rev.* 62(3):775-806. Such references are herein incorporated by reference.

To date four categories of Vips have been identified. Some Vip genes form binary two-component protein complexes; an "A" component is usually the "active" portion, and a "B" component is usually the "binding" portion. (Pfam_pfam.xfam.org/family/PF03495.) The Vip1 and Vip4 proteins generally contain binary toxin B protein domains. Vip2 proteins generally contain binary toxin A protein domains.

The Vip1 and Vip2 proteins are the two components of a binary toxin that exhibits toxicity to coleopterans. Vip1Aa1 and Vip2Aa1 are very active against corn rootworms, particularly *Diabrotica virgifera* and *Diabrotica longicornis* (Han et al. (1999) *Nat. Struct. Biol.* 6:932-936; Warren G W (1997) "Vegetative insecticidal proteins: novel proteins for control of corn pests" In: Carozzi N B, Koziel M (eds) *Advances in insect control, the role of transgenic plants*; Taylor & Francis Ltd, London, pp 109-21). The membrane-binding 95 kDa Vip1 multimer provides a pathway for the 52 kDa Vip2 ADP-ribosylase to enter the cytoplasm of target western corn rootworm cells (Warren (1997) supra). The NAD-dependent ADP-ribosyltransferase Vip2 likely modifies monomeric actin at Arg177 to block polymerization, leading to loss of the actin cytoskeleton and eventual cell death due to the rapid subunit exchange within actin filaments in vivo (Carlier M. F. (1990) *Adv. Biophys.* 26:51-73).

Like Cry toxins, activated Vip3A toxins are pore-forming proteins capable of making stable ion channels in the membrane (Lee et al. (2003) *Appl. Environ. Microbiol.* 69:4648-4657). Vip3 proteins are active against several major lepidopteran pests (Rang et al. (2005) *Appl. Environ. Microbiol.* 71(10):6276-6281; Bhalla et al. (2005) *FEMS Microbiol. Lett.* 243:467-472; Estruch et al. (1998) WO 9844137; Estruch et al. (1996) *Proc Natl Acad Sci USA* 93:5389-5394; Selvapandiyan et al. (2001) *Appl. Environ Microbiol.* 67:5855-5858; Yu et al. (1997) *Appl. Environ Microbiol.* 63:532-536). Vip3A is active against *Agrotis Spodoptera frugiperda, Spodoptera exigua, Heliothis virescens*, and *Helicoverpa zea* (Warren et al. (1996) WO 96/10083; Estruch et al. (1996) *Proc Natl Acad Sci USA* 93:5389-5394). Like Cry toxins, Vip3A proteins must be activated by proteases prior to recognition at the surface of the midgut epithelium of specific membrane proteins different from those recognized by Cry toxins.

The MTX family of toxin proteins is characterized by the presence of a conserved domain, ETX_MTX2 (pfam 03318). Members of this family share sequence homology with the mosquitocidal toxins Mtx2 and Mtx3 from *Bacillus sphaericus*, as well as with the epsilon toxin ETX from *Clostridium perfringens* (Cole et al. (2004) *Nat. Struct. Mol. Biol.* 11: 797-8; Thanabalu et al. (1996) *Gene* 170:85-9). The MTX-like proteins are structurally distinct from the three-domain Cry toxins, as they have an elongated and predominately β-sheet-based structure. However, similar to the three-domain toxins, the MTX-like proteins are thought to form pores in the membranes of target cells (Adang et al. (2014) supra). Unlike the three-domain Cry proteins, the MTX-like proteins are much smaller in length, ranging from 267 amino acids (Cry23) to 340 amino acids (Cry15A).

To date, only 15 proteins belonging to the family of MTX-like toxins have been assigned Cry names, making this a relatively small class compared to the three-domain Cry family (Crickmore et al. (2014) supra; Adang et al. (2014) supra). The members of the MTX-like toxin family include Cry15, Cry23, Cry33, Cry38, Cry45, Cry46, Cry51, Cry60A, Cry60B, and Cry64. This family exhibits a range of insecticidal activity, including activity against insect pests of the Lepidopteran and Coleopteran orders. Some members of this family may form binary partnerships with other proteins, which may or may not be required for insecticidal activity.

Cry15 is a 34 kDA protein that was identified in *B. thuringiensis* serovar thompsoni HD542. Cry15 occurs naturally in a crystal together with an unrelated protein of approximately 40 kDa. The gene encoding Cry15 and its partner protein are arranged together in an operon. Cry15 alone has been shown to have activity against lepidopteran insect pests including *Manduca sexta*, *Cydia pomonella*, and *Pieris rapae*, with the presence of the 40 kDA protein having been shown to increase activity of Cry15 only against *C. pomonella* (Brown K. and Whiteley H. (1992) *J. Bacteriol.* 174:549-557; Naimov et al. (2008) *Appl. Environ. Microbiol.* 74:7145-7151). Further studies are needed to elucidate the function of the partner protein of Cry15. Similarly, Cry23 is a 29 kDA protein that has been shown to have activity against the coleopteran pests *Tribolium castaneum* and *Popillia japonica* together with its partner protein Cry37 (Donovan et al. (2000) U.S. Pat. No. 6,063,756).

New members of the MTX-like family are continuing to be identified. An ETX_MTX toxin gene was recently identified in the genome of *Bacillus thuringiensis* serovar tolworthi strain Na205-3. This strain was found to be toxic against the lepidpoteran pest *Helicoverpa armigera*, and it also contained homologs of Cry1, Cry11, Vip1, Vip2, and Vip3 (Palma et al. (2014) *Genome Announc.* 2(2): e00187-14. Published online Mar. 13, 2014 at doi: 10.1128/genomeA.00187-14; PMCID: PMC3953196). Because the MTX-like proteins have a unique domain structure relative to the three-domain Cry proteins, they are believed to possess a unique mode of action, thereby making them a valuable tool in insect control and the fight against insect resistance.

Bacterial cells produce large numbers of toxins with diverse specificity against host and non-host organisms. Large families of binary toxins have been identified in numerous bacterial families, including toxins that have activity against insect pests. (Poopathi and Abidha (2010) *J. Physiol. Path.* 1(3): 22-38). *Lysinibacillus sphaericus* (Ls), formerly *Bacillus sphaericus*, (Ahmed et al. (2007) *Int. J. Syst. Evol. Microbiol.* 57:1117-1125) is well-known as an insect biocontrol strain. Ls produces several insecticidal proteins, including the highly potent binary complex BinA/BinB. This binary complex forms a parasporal crystal in Ls cells and has strong and specific activity against dipteran insects, specifically mosquitoes. In some areas, insect resistance to existing Ls mosquitocidal strains has been reported. The discovery of new binary toxins with different target specificity or the ability to overcome insect resistance is of significant interest.

The Ls binary insecticidal protein complex contains two major polypeptides, a 42 kDa polypeptide and a 51 kDa polypeptide, designated BinA and BinB, respectively (Ahmed et al. (2007), supra). The two polypeptides act synergistically to confer toxicity to their targets. Mode of action involves binding of the proteins to receptors in the larval midgut. In some cases, the proteins are modified by protease digestion in the larval gut to produce activated forms. The BinB component is thought to be involved in binding, while the BinA component confers toxicity (Nielsen-LeRoux et al. (2001) *Appl. Environ. Microbiol.* 67(11):5049-5054). When cloned and expressed separately, the BinA component is toxic to mosquito larvae, while the BinB component is not. However, co-administration of the proteins markedly increases toxicity (Nielsen-LeRoux et al. (2001) supra).

A small number of Bin protein homologs have been described from bacterial sources. Priest et al. (1997) *Appl. Environ. Microbiol.* 63(4):1195-1198 describe a hybridization effort to identify new Ls strains, although most of the genes they identified encoded proteins identical to the known BinA/BinB proteins. The BinA protein contains a defined conserved domain known as the Toxin 10 superfamily domain. This toxin domain was originally defined by its presence in BinA and BinB. The two proteins both have the domain, although the sequence similarity between BinA and BinB is limited in this region (<40%). The Cry49Aa protein, which also has insecticidal activity, also has this domain (described below).

The Cry48Aa/Cry49Aa binary toxin of Ls has the ability to kill *Culex quinquefasciatus* mosquito larvae. These proteins are in a protein structural class that has some similarity to the *B. thuringiensis* (Bt) Cry protein complex. The Cry34/Cry35 binary toxin of Bt is also known to kill insects, including Western corn rootworm, a significant pest of corn. Cry34, of which several variants have been identified, is a small (14 kDa) polypeptide, while Cry35 (also encoded by several variants) is a 44 kDa polypeptide. These proteins have some sequence homology with the BinA/BinB protein group and are thought to be evolutionarily related (Ellis et al. (2002) *Appl. Environ. Microbiol.* 68(3):1137-1145).

Provided herein are pesticidal proteins from these classes of toxins. The pesticidal proteins are classified by their structure, homology to known toxins and/or their pesticidal specificity.

ii. Variants and Fragments of Pesticidal Proteins and Polynucleotides Encoding the Same Pesticidal proteins or polypeptides of the invention include those set forth in SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, and/or 159 and fragments and variants thereof. By "pesticidal toxin" or "pesticidal protein" or "pesticidal polypeptide" is intended a toxin or protein or polypeptide that has activity against one or more pests, including, insects, fungi, nematodes, and the like such that the pest is killed or controlled.

An "isolated" or "purified" polypeptide or protein, or biologically active portion thereof, is substantially or essentially free from components that normally accompany or interact with the polypeptide or protein as found in its naturally occurring environment. Thus, an isolated or purified polypeptide or protein is substantially free of other cellular material, or culture medium when produced by recombinant techniques, or substantially free of chemical precursors or other chemicals when chemically synthesized. A protein that is substantially free of cellular material includes preparations of protein having less than about 30%, 20%, 10%, 5%, or 1% (by dry weight) of contaminating protein. When the protein of the invention or biologically active portion thereof is recombinantly produced, optimally culture medium represents less than about 30%, 20%, 10%, 5%, or 1% (by dry weight) of chemical precursors or non-protein-of-interest chemicals.

The term "fragment" refers to a portion of a polypeptide sequence of the invention. "Fragments" or "biologically active portions" include polypeptides comprising a sufficient number of contiguous amino acid residues to retain the biological activity (have pesticidal activity). Fragments of the pesticidal proteins include those that are shorter than the full-length sequences, either due to the use of an alternate downstream start site, or due to processing that produces a shorter protein having pesticidal activity. Processing may occur in the organism the protein is expressed in, or in the pest after ingestion of the protein. Examples of fragments of the proteins can be found in Table 1. A biologically active portion of a pesticidal protein can be a polypeptide that is, for example, 10, 25, 50, 100, 150, 200, 250 or more amino acids in length of any one of SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, and/or 159. Such biologically active portions can be prepared by recombinant techniques and evaluated for pesticidal activity. As used here, a fragment comprises at least 8 contiguous amino acids of SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, and/or 159.

Bacterial genes, including those encoding the pesticidal proteins disclosed herein, quite often possess multiple methionine initiation codons in proximity to the start of the open reading frame. Often, translation initiation at one or more of these start codons will lead to generation of a functional protein. These start codons can include ATG codons. However, bacteria such as Bacillus sp. also recognize the codon GTG as a start codon, and proteins that initiate translation at GTG codons contain a methionine at the first amino acid. On rare occasions, translation in bacterial systems can initiate at a TTG codon, though in this event the TTG encodes a methionine. Furthermore, it is not often determined a priori which of these codons are used naturally in the bacterium. Thus, it is understood that use of one of the alternate methionine codons may also lead to generation of pesticidal proteins. These pesticidal proteins are encompassed in the present invention and may be used in the methods disclosed herein. It will be understood that, when expressed in plants, it will be necessary to alter the alternate start codon to ATG for proper translation.

In various embodiments the pesticidal proteins provided herein include amino acid sequences deduced from the full-length nucleotide sequences and amino acid sequences that are shorter than the full-length sequences due to the use of an alternate downstream start site. Thus, the nucleotide sequence of the invention and/or vectors, host cells, and plants comprising the nucleotide sequence of the invention (and methods of making and using the nucleotide sequence of the invention) may comprise a nucleotide sequence encoding an alternate start site.

It is recognized that modifications may be made to the pesticidal polypeptides provided herein creating variant proteins. Changes designed by man may be introduced through the application of site-directed mutagenesis techniques. Alternatively, native, as yet-unknown or as yet unidentified polynucleotides and/or polypeptides structurally and/or functionally-related to the sequences disclosed herein may also be identified that fall within the scope of the present invention. Conservative amino acid substitutions may be made in non-conserved regions that do not alter the function of the pesticidal proteins. Alternatively, modifications may be made that improve the activity of the toxin. For example, various Cry protein variants are contemplated. Modification of Cry toxins by domain III swapping has resulted in some cases in hybrid toxins with improved toxicities against certain insect species. Thus, domain III swapping could be an effective strategy to improve toxicity of Cry toxins or to create novel hybrid toxins with toxicity against pests that show no susceptibility to the parental Cry toxins. Site-directed mutagenesis of domain II loop sequences may result in new toxins with increased insecticidal activity. Domain II loop regions are key binding regions of initial Cry toxins that are suitable targets for the mutagenesis and selection of Cry toxins with improved insecticidal properties. Domain I of the Cry toxin may be modified to introduce protease cleavage sites to improve activity against certain pests. Strategies for shuffling the three different domains among large numbers of cry genes and high through output bioassay screening methods may provide novel Cry toxins with improved or novel toxicities.

As indicated, fragments and variants of the polypeptides disclosed herein will retain pesticidal activity Pesticidal activity comprises the ability of the composition to achieve an observable effect diminishing the occurrence or an activity of the target pest, including for example, bringing about death of at least one pest, or a noticeable reduction in pest growth, feeding, or normal physiological development. Such decreases in numbers, pest growth, feeding or normal development can comprise any statistically significant decrease, including, for example a decrease of about 5%, 10%, 15%, 20%, 25%, 30%, 35%, 40%, 45%, 50%, 55%, 60%, 65%, 70%, 75%, 85%, 90%, 95% or greater. The pesticidal activity against one or more of the various pests provided herein, including, for example, pesticidal activity against Coleoptera, Diptera, Hymenoptera, Lepidoptera, Mallophaga, Homoptera, Hemiptera, Orthroptera, Nematodes, Thysanoptera, Dermaptera, Isoptera, Anoplura, Siphonaptera, Trichoptera, etc., or any other pest described herein. It is recognized that the pesticidal activity may be different or improved relative to the activity of the native protein, or it may be unchanged, so long as pesticidal activity is retained. Methods for measuring pesticidal activity are provide elsewhere herein. See also, Czapla and Lang (1990) *J. Econ.*

*Entomol.* 83:2480-2485; Andrews et al. (1988) *Biochem. J.* 252:199-206; Marrone et al. (1985) *J. of Economic Entomology* 78:290-293; and U.S. Pat. No. 5,743,477, all of which are herein incorporated by reference in their entirety.

Variants of this disclosure include polypeptides having an amino acid sequence that is at least about 60%, about 65%, about 70%, about 75%, about 80%, about 85%, about 86%, about 87%, about 88%, about 89%, about 90%, about 91%, about 92%, about 93%, about 94%, about 95%, about 96%, about 97%, about 98% or about 99% identical to the amino acid sequence of any of SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, and/or 159 and retain pesticidal activity. Table 1 provides non-limiting examples of variant polypeptides (and polynucleotide encoding the same) for each of SEQ ID NOS: 1-159. A biologically active variant of a pesticidal polypeptide provided herein may differ by as few as about 1-15 amino acid residues, as few as about 1-10, such as about 6-10, as few as 5, as few as 4, as few as 3, as few as 2, or as few as 1 amino acid residue. In specific embodiments, the polypeptides can comprise an N'-terminal or a C'-terminal truncation, which can comprise at least a deletion of 10, 15, 20, 25, 30, 35, 40, 45, 50 amino acids or more from either the N' or C' terminal end of the polypeptide.

Table 2 provides protein domains found in SEQ ID NOs: 1-159 based on PFAM data. Both the domain description and the positions within a given SEQ ID NO are provided in Table 2. In specific embodiments, the active variant comprising any one of SEQ ID NOs: 1-159 can comprise at least 70%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to any one of SEQ ID NOs: 1-159 and further comprises at least one of the conserved domain set forth in Table 2. For example, in one embodiment, the active variant will comprise at least 70%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:15, and further comprises the native amino acids at positions 78-329, the native amino acids at positions 554-708, or the native amino acids at positions 78-329 and positions 554-708.

TABLE 2

Summary of PFAM domains in each of SEQ ID NOs: 1-159

| APG ID | SEQ ID NO | Modification Type | PFAM domain | Domain Description | Domain positions Start | Stop |
|---|---|---|---|---|---|---|
| APG00002 | SEQ ID NO: 1 | | PF03945 | Endotoxin N | 141 | 398 |
| | | | PF03944 | Endotoxin C | 623 | 778 |
| APG00002 modified | SEQ ID NO: 2 | 3' Truncation | PF03945 | Endotoxin N | 141 | 398 |
| | | | PF03944 | Endotoxin C | 623 | 777 |
| APG00005 | SEQ ID NO: 4 | | PF03945 | Endotoxin N | 69 | 297 |
| | | | PF03944 | Endotoxin C | 515 | 657 |
| APG00005 modified | SEQ ID NO: 5 | 3' Truncation | PF03945 | Endotoxin N | 69 | 297 |
| | | | PF03944 | Endotoxin C | 515 | 657 |
| APG00010 | SEQ ID NO: 8 | | PF03318 | ETX MTX2 | 33 | 300 |
| APG00010 modified | SEQ ID NO: 9 | Signal Peptide removed | PF03318 | ETX MTX2 | 15 | 274 |
| APG00027 | SEQ ID NO: 10 | | PF03945 | Endotoxin N | 96 | 347 |
| | | | PF03944 | Endotoxin C | 527 | 662 |
| APG00027 modified | SEQ ID NO: 11 | Signal Peptide removed | PF03945 | Endotoxin N | 66 | 317 |
| | | | PF03944 | Endotoxin C | 497 | 632 |
| APG00027 modified | SEQ ID NO: 12 | 3' Truncation | PF03945 | Endotoxin N | 96 | 347 |
| | | | PF03944 | Endotoxin C | 527 | 661 |
| APG00027 modified | SEQ ID NO: 13 | Signal Peptide removed and 3' Truncation | PF03945 | Endotoxin N | 65 | 317 |
| | | | PF03944 | Endotoxin C | 497 | 631 |
| APG00034 | SEQ ID NO: 14 | | PF03945 | Endotoxin N | 78 | 329 |
| | | | PF03944 | Endotoxin C | 554 | 709 |
| APG00034 modified | SEQ ID NO: 15 | 3' Truncation | PF03945 | Endotoxin N | 78 | 329 |
| | | | PF03944 | Endotoxin C | 554 | 708 |
| APG00039 | SEQ ID NO: 16 | | PF03945 | Endotoxin N | 82 | 305 |
| | | | PF00555 | Endotoxin M | 310 | 516 |
| | | | PF03944 | Endotoxin C | 526 | 659 |
| | | | PF14200 | Ricin B Lectin 2 | 694 | 794 |
| APG00039 modified | SEQ ID NO: 17 | Alternate start | PF03945 | Endotoxin N | 79 | 302 |
| | | | PF00555 | Endotoxin M | 307 | 513 |
| | | | PF03944 | Endotoxin C | 523 | 656 |
| | | | PF14200 | Ricin B Lectin 2 | 691 | 791 |
| APG00039 modified | SEQ ID NO: 18 | 3' Truncation | PF03945 | Endotoxin N | 82 | 305 |
| | | | PF00555 | Endotoxin M | 310 | 516 |
| | | | PF03944 | Endotoxin C | 526 | 658 |
| APG00039 modified | SEQ ID NO: 19 | Alternate start and 3' Truncation | PF03945 | Endotoxin N | 79 | 302 |
| | | | PF00555 | Endotoxin M | 307 | 513 |
| | | | PF03944 | Endotoxin C | 523 | 655 |

TABLE 2-continued

Summary of PFAM domains in each of SEQ ID NOs: 1-159

| APG ID | SEQ ID NO | Modification Type | PFAM domain | Domain Description | Domain positions Start | Stop |
|---|---|---|---|---|---|---|
| APG00046 | SEQ ID NO: 20 | | PF03945 | Endotoxin N | 59 | 292 |
| | | | PF00555 | Endotoxin M | 297 | 508 |
| | | | PF03944 | Endotoxin C | 518 | 648 |
| | | | PF14200 | Ricin B Lectin 2 | 686 | 788 |
| APG00046 modified | SEQ ID NO: 21 | 3' Truncation | PF03945 | Endotoxin N | 59 | 292 |
| | | | PF00555 | Endotoxin M | 297 | 508 |
| | | | PF03944 | Endotoxin C | 518 | 647 |
| APG00048 | SEQ ID NO: 22 | | PF03945 | Endotoxin N | 93 | 343 |
| | | | PF00555 | Endotoxin M | 348 | 546 |
| | | | PF03944 | Endotoxin C | 559 | 711 |
| APG00048 modified | SEQ ID NO: 23 | 3' Truncation | PF03945 | Endotoxin N | 93 | 343 |
| | | | PF00555 | Endotoxin M | 348 | 546 |
| | | | PF03944 | Endotoxin C | 559 | 710 |
| APG00048 CryBP1 | SEQ ID NO: 24 | | PF07029 | CryBP1 | 49 | 209 |
| APG00052 | SEQ ID NO: 25 | | PF03945 | Endotoxin N | 62 | 315 |
| | | | PF00555 | Endotoxin M | 320 | 520 |
| | | | PF03944 | Endotoxin C | 533 | 677 |
| APG00052 modified | SEQ ID NO: 26 | 3' Truncation | PF03945 | Endotoxin N | 62 | 315 |
| | | | PF00555 | Endotoxin M | 320 | 520 |
| | | | PF03944 | Endotoxin C | 533 | 676 |
| APG00059 | SEQ ID NO: 27 | | PF03945 | Endotoxin N | 67 | 288 |
| | | | PF00555 | Endotoxin M | 293 | 502 |
| | | | PF03944 | Endotoxin C | 512 | 652 |
| APG00059 modified | SEQ ID NO: 28 | 3' Truncation | PF03945 | Endotoxin N | 67 | 288 |
| | | | PF00555 | Endotoxin M | 293 | 502 |
| | | | PF03944 | Endotoxin C | 512 | 651 |
| APG00062 | SEQ ID NO: 29 | | PF03945 | Endotoxin N | 60 | 310 |
| | | | PF03944 | Endotoxin C | 516 | 650 |
| APG00062 modified | SEQ ID NO: 30 | 3' Truncation | PF03945 | Endotoxin N | 60 | 310 |
| | | | PF03944 | Endotoxin C | 516 | 649 |
| APG00065 | SEQ ID NO: 31 | | PF05431 | Toxin 10 | 209 | 402 |
| APG00065 modified | SEQ ID NO: 32 | Signal Peptide removed | PF05431 | Toxin 10 | 171 | 364 |
| APG00066 | SEQ ID NO: 33 | | PF03945 | Endotoxin N | 91 | 325 |
| | | | PF00555 | Endotoxin M | 333 | 532 |
| | | | PF03944 | Endotoxin C | 552 | 715 |
| APG00066 modified | SEQ ID NO: 34 | 3' Truncation | PF03945 | Endotoxin N | 91 | 325 |
| | | | PF00555 | Endotoxin M | 333 | 532 |
| | | | PF03944 | Endotoxin C | 552 | 714 |
| APG00068 | SEQ ID NO: 35 | | PF03945 | Endotoxin N | 63 | 302 |
| | | | PF00555 | Endotoxin M | 307 | 518 |
| | | | PF03944 | Endotoxin C | 528 | 668 |
| APG00068 modified | SEQ ID NO: 36 | 3' Truncation | PF03945 | Endotoxin N | 63 | 302 |
| | | | PF00555 | Endotoxin M | 307 | 518 |
| | | | PF03944 | Endotoxin C | 528 | 667 |
| APG00070 | SEQ ID NO: 37 | | PF03945 | Endotoxin N | 63 | 286 |
| | | | PF03944 | Endotoxin C | 460 | 597 |
| APG00070 modified | SEQ ID NO: 38 | 3' Truncation | PF03945 | Endotoxin N | 63 | 286 |
| | | | PF03944 | Endotoxin C | 460 | 596 |
| APG00072 | SEQ ID NO: 39 | | PF03945 | Endotoxin N | 1 | 111 |
| APG00075 | SEQ ID NO: 40 | | PF05431 | Toxin 10 | 279 | 474 |
| APG00076 | SEQ ID NO: 41 | | PF03945 | Endotoxin N | 78 | 335 |
| | | | PF00555 | Endotoxin M | 340 | 532 |
| | | | PF03944 | Endotoxin C | 542 | 682 |
| APG00076 modified | SEQ ID NO: 42 | 3' Truncation | PF03945 | Endotoxin N | 78 | 335 |
| | | | PF00555 | Endotoxin M | 340 | 532 |
| | | | PF03944 | Endotoxin C | 542 | 681 |
| APG00079 | SEQ ID NO: 43 | | PF03945 | Endotoxin N | 61 | 284 |
| | | | PF00555 | Endotoxin M | 289 | 495 |
| | | | PF03944 | Endotoxin C | 505 | 633 |
| APG00079 modified | SEQ ID NO: 44 | 3' Truncation | PF03945 | Endotoxin N | 61 | 284 |
| | | | PF00555 | Endotoxin M | 289 | 495 |
| | | | PF03944 | Endotoxin C | 505 | 632 |
| APG00085 | SEQ ID NO: 45 | | PF03945 | Endotoxin N | 90 | 312 |
| | | | PF00555 | Endotoxin M | 317 | 528 |
| | | | PF03944 | Endotoxin C | 538 | 676 |
| | | | PF14200 | Ricin B Lectin 2 | 715 | 823 |

TABLE 2-continued

Summary of PFAM domains in each of SEQ ID NOs: 1-159

| APG ID | SEQ ID NO | Modification Type | PFAM domain | Domain Description | Domain positions Start | Stop |
|---|---|---|---|---|---|---|
| APG00085 modified | SEQ ID NO: 46 | 3' Truncation | PF03945 | Endotoxin N | 90 | 312 |
| | | | PF00555 | Endotoxin M | 317 | 528 |
| | | | PF03944 | Endotoxin C | 538 | 675 |
| APG00087 | SEQ ID NO: 47 | | PF03945 | Endotoxin N | 40 | 276 |
| | | | PF00555 | Endotoxin M | 281 | 472 |
| | | | PF03944 | Endotoxin C | 482 | 619 |
| APG00087 modified | SEQ ID NO: 48 | 3' Truncation | PF03945 | Endotoxin N | 40 | 276 |
| | | | PF00555 | Endotoxin M | 281 | 472 |
| | | | PF03944 | Endotoxin C | 482 | 618 |
| APG00090 | SEQ ID NO: 49 | | PF00652 | Ricin B Lectin | 38 | 165 |
| | | | PF05431 | Toxin 10 | 175 | 373 |
| APG00094 | SEQ ID NO: 50 | | PF03945 | Endotoxin N | 68 | 318 |
| | | | PF00555 | Endotoxin M | 325 | 432 |
| | | | PF03944 | Endotoxin C | 524 | 660 |
| APG00094 modified | SEQ ID NO: 51 | 3' Truncation | PF03945 | Endotoxin N | 68 | 318 |
| | | | PF00555 | Endotoxin M | 325 | 432 |
| | | | PF03944 | Endotoxin C | 524 | 659 |
| APG00095 | SEQ ID NO: 52 | | PF05431 | Toxin 10 | 192 | 383 |
| APG00097 | SEQ ID NO: 53 | | PF03945 | Endotoxin N | 87 | 345 |
| | | | PF03944 | Endotoxin C | 576 | 736 |
| APG00097 modified | SEQ ID NO: 54 | 3' Truncation | PF03945 | Endotoxin N | 87 | 345 |
| | | | PF03944 | Endotoxin C | 576 | 735 |
| APG00099 | SEQ ID NO: 55 | | PF03945 | Endotoxin N | 67 | 318 |
| | | | PF03944 | Endotoxin C | 529 | 671 |
| APG00099 modified | SEQ ID NO: 56 | 3' Truncation | PF03945 | Endotoxin N | 67 | 318 |
| | | | PF03944 | Endotoxin C | 529 | 670 |
| APG00101 | SEQ ID NO: 57 | | PF03945 | Endotoxin N | 78 | 329 |
| | | | PF03944 | Endotoxin C | 557 | 701 |
| APG00101 modified | SEQ ID NO: 58 | 3' Truncation | PF03945 | Endotoxin N | 78 | 329 |
| | | | PF03944 | Endotoxin C | 557 | 700 |
| APG00104 | SEQ ID NO: 59 | | PF12495 | Vip3A N | 16 | 188 |
| | | | PF02018 | CBM 4 9 | 544 | 669 |
| APG00110 | SEQ ID NO: 60 | | PF03945 | Endotoxin N | 90 | 325 |
| | | | PF03944 | Endotoxin C | 512 | 645 |
| | | | PF01473 | CW binding 1 | 723 | 740 |
| | | | PF01473 | CW binding 1 | 752 | 769 |
| | | | PF01473 | CW binding 1 | 802 | 816 |
| APG00110 modified | SEQ ID NO: 61 | Signal Peptide removed | PF03945 | Endotoxin N | 60 | 295 |
| | | | PF03944 | Endotoxin C | 482 | 615 |
| | | | PF01473 | CW binding 1 | 693 | 710 |
| | | | PF01473 | CW binding 1 | 722 | 739 |
| | | | PF01473 | CW binding 1 | 772 | 786 |
| APG00110 modified | SEQ ID NO: 62 | 3' Truncation | PF03945 | Endotoxin N | 90 | 325 |
| | | | PF03944 | Endotoxin C | 512 | 642 |
| APG00110 modified | SEQ ID NO: 63 | Signal Peptide removed and 3' Truncation | PF03945 | Endotoxin N | 60 | 295 |
| | | | PF03944 | Endotoxin C | 482 | 612 |
| APG00114 | SEQ ID NO: 64 | | PF03945 | Endotoxin N | 54 | 301 |
| | | | PF00030 | Crystall | 730 | 810 |
| APG00115 | SEQ ID NO: 65 | | PF03945 | Endotoxin N | 71 | 283 |
| | | | PF03945 | Endotoxin N | 301 | 361 |
| | | | PF00555 | Endotoxin M | 366 | 584 |
| | | | PF03944 | Endotoxin C | 594 | 726 |
| APG00115 modified | SEQ ID NO: 66 | 3' Truncation | PF03945 | Endotoxin N | 71 | 283 |
| | | | PF03945 | Endotoxin N | 299 | 361 |
| | | | PF00555 | Endotoxin M | 366 | 584 |
| | | | PF03944 | Endotoxin C | 594 | 725 |
| APG00115 CryBP1 | SEQ ID NO: 67 | | PF07029 | CryBP1 | 74 | 129 |
| APG00120 | SEQ ID NO: 68 | | PF03945 | Endotoxin N | 72 | 281 |
| | | | PF03945 | Endotoxin N | 311 | 351 |
| | | | PF00555 | Endotoxin M | 358 | 564 |
| | | | PF03944 | Endotoxin C | 574 | 713 |
| APG00120 modified | SEQ ID NO: 69 | 3' Truncation | PF03945 | Endotoxin N | 72 | 281 |
| | | | PF03945 | Endotoxin N | 311 | 351 |
| | | | PF00555 | Endotoxin M | 358 | 564 |
| | | | PF03944 | Endotoxin C | 574 | 712 |
| APG00124 | SEQ ID NO: 70 | | PF03945 | Endotoxin N | 61 | 289 |
| | | | PF00555 | Endotoxin M | 294 | 523 |
| | | | PF03944 | Endotoxin C | 533 | 670 |

TABLE 2-continued

Summary of PFAM domains in each of SEQ ID NOs: 1-159

| APG ID | SEQ ID NO | Modification Type | PFAM domain | Domain Description | Domain positions Start | Stop |
|---|---|---|---|---|---|---|
| APG00124 modified | SEQ ID NO: 71 | 3' Truncation | PF03945 | Endotoxin N | 61 | 289 |
|  |  |  | PF00555 | Endotoxin M | 294 | 523 |
|  |  |  | PF03944 | Endotoxin C | 533 | 669 |
| APG00130 | SEQ ID NO: 72 |  | PF03945 | Endotoxin N | 68 | 320 |
|  |  |  | PF00555 | Endotoxin M | 327 | 512 |
|  |  |  | PF03944 | Endotoxin C | 522 | 662 |
| APG00130 CryBP1 | SEQ ID NO: 73 |  | PF07029 | CryBP1 | 39 | 196 |
| APG00130 Split-Cry C-term | SEQ ID NO: 74 |  | — |  |  |  |
| APG00136 | SEQ ID NO: 75 |  | PF03945 | Endotoxin N | 37 | 270 |
|  |  |  | PF03945 | Endotoxin N | 299 | 346 |
|  |  |  | PF03944 | Endotoxin C | 592 | 729 |
| APG00136 modified | SEQ ID NO: 76 | 3' Truncation | PF03945 | Endotoxin N | 37 | 270 |
|  |  |  | PF03945 | Endotoxin N | 299 | 346 |
|  |  |  | PF03944 | Endotoxin C | 592 | 728 |
| APG00136 Split-Cry C-term | SEQ ID NO: 77 |  | no PFAM domains |  |  |  |
| APG00140 | SEQ ID NO: 78 |  | PF03945 | Endotoxin N | 63 | 313 |
|  |  |  | PF00555 | Endotoxin M | 320 | 510 |
|  |  |  | PF03944 | Endotoxin C | 520 | 657 |
|  |  |  | PF14200 | Ricin B Lectin 2 | 703 | 802 |
| APG00140 modified | SEQ ID NO: 79 | 3' Truncation | PF03945 | Endotoxin N | 63 | 313 |
|  |  |  | PF00555 | Endotoxin M | 320 | 510 |
|  |  |  | PF03944 | Endotoxin C | 520 | 656 |
| APG00140 Split-Cry C-term | SEQ ID NO: 80 |  | no PFAM domains |  |  |  |
| APG00144 | SEQ ID NO: 81 |  | PF05431 | Toxin 10 | 139 | 345 |
| APG00162 | SEQ ID NO: 82 |  | PF03945 | Endotoxin N | 87 | 330 |
|  |  |  | PF00555 | Endotoxin M | 335 | 533 |
|  |  |  | PF03944 | Endotoxin C | 543 | 689 |
| APG00162 modified | SEQ ID NO: 83 | 3' Truncation | PF03945 | Endotoxin N | 87 | 330 |
|  |  |  | PF00555 | Endotoxin M | 335 | 533 |
|  |  |  | PF03944 | Endotoxin C | 543 | 688 |
| APG00183 | SEQ ID NO: 84 |  | PF05431 | Toxin 10 | 159 | 357 |
| APG00195 | SEQ ID NO: 85 |  | PF03945 | Endotoxin N | 207 | 368 |
|  |  |  | PF03944 | Endotoxin C | 577 | 719 |
| APG00195 modified | SEQ ID NO: 86 | Signal Peptide removed | PF03945 | Endotoxin N | 166 | 331 |
|  |  |  | PF03944 | Endotoxin C | 540 | 682 |
| APG00195 modified | SEQ ID NO: 87 | 3' Truncation | PF03945 | Endotoxin N | 210 | 368 |
|  |  |  | PF03944 | Endotoxin C | 577 | 718 |
| APG00195 modified | SEQ ID NO: 88 | Signal Peptide removed and 3' Truncation | PF03945 | Endotoxin N | 174 | 331 |
|  |  |  | PF03944 | Endotoxin C | 540 | 681 |
| APG00204 | SEQ ID NO: 89 |  | PF03945 | Endotoxin N | 57 | 289 |
|  |  |  | PF00555 | Endotoxin M | 294 | 493 |
|  |  |  | PF03944 | Endotoxin C | 503 | 632 |
| APG00204 modified | SEQ ID NO: 90 | 3' Truncation | PF03945 | Endotoxin N | 57 | 289 |
|  |  |  | PF00555 | Endotoxin M | 294 | 493 |
|  |  |  | PF03944 | Endotoxin C | 503 | 631 |
| APG00204 Split-Cry C-term | SEQ ID NO: 91 |  | no PFAM domains |  |  |  |
| APG00076 modified | SEQ ID NO: 92 | Alternate start | PF03945 | Endotoxin N | 69 | 326 |
|  |  |  | PF00555 | Endotoxin M | 331 | 523 |
|  |  |  | PF03944 | Endotoxin C | 533 | 673 |
| APG00076 modified | SEQ ID NO: 93 | Alternate start and 3' Truncation | PF03945 | Endotoxin N | 69 | 326 |
|  |  |  | PF00555 | Endotoxin M | 331 | 523 |
|  |  |  | PF03944 | Endotoxin C | 533 | 672 |
| APG00130 modified | SEQ ID NO: 94 | Alternate start | PF03945 | Endotoxin N | 63 | 315 |
|  |  |  | PF00555 | Endotoxin M | 322 | 507 |
|  |  |  | PF03944 | Endotoxin C | 517 | 657 |
| APG00002 modified | SEQ ID NO: 95 | Alternate start | PF03945 | Endotoxin N | 76 | 333 |
|  |  |  | PF03944 | Endotoxin C | 558 | 713 |
| APG00002 modified | SEQ ID NO: 96 | Alternate start and 3' Truncation | PF03945 | Endotoxin N | 76 | 333 |
|  |  |  | PF03944 | Endotoxin C | 558 | 712 |

TABLE 2-continued

Summary of PFAM domains in each of SEQ ID NOs: 1-159

| APG ID | SEQ ID NO | Modification Type | PFAM domain | Domain Description | Domain positions Start | Stop |
|---|---|---|---|---|---|---|
| APG00046 modified | SEQ ID NO: 97 | Alternate start | PF03945 | Endotoxin N | 56 | 289 |
| | | | PF00555 | Endotoxin M | 294 | 505 |
| | | | PF03944 | Endotoxin C | 515 | 645 |
| | | | PF14200 | Ricin B Lectin 2 | 683 | 785 |
| APG00046 modified | SEQ ID NO: 98 | Alternate start and 3' Truncation | PF03945 | Endotoxin N | 56 | 289 |
| | | | PF00555 | Endotoxin M | 294 | 505 |
| | | | PF03944 | Endotoxin C | 515 | 644 |
| APG00048 modified | SEQ ID NO: 99 | Alternate start | PF03945 | Endotoxin N | 78 | 328 |
| | | | PF00555 | Endotoxin M | 333 | 531 |
| | | | PF03944 | Endotoxin C | 544 | 696 |
| APG00048 modified | SEQ ID NO: 100 | Alternate start and 3' Truncation | PF03945 | Endotoxin N | 78 | 328 |
| | | | PF00555 | Endotoxin M | 333 | 531 |
| | | | PF03944 | Endotoxin C | 544 | 696 |
| APG00059 modified | SEQ ID NO: 101 | Alternate start | PF03945 | Endotoxin N | 61 | 282 |
| | | | PF00555 | Endotoxin M | 287 | 496 |
| | | | PF03944 | Endotoxin C | 506 | 646 |
| APG00059 modified | SEQ ID NO: 102 | Alternate start and 3' Truncation | PF03945 | Endotoxin N | 61 | 282 |
| | | | PF00555 | Endotoxin M | 287 | 496 |
| | | | PF03944 | Endotoxin C | 506 | 645 |
| APG00066 modified | SEQ ID NO: 103 | Alternate start | PF03945 | Endotoxin N | 74 | 308 |
| | | | PF00555 | Endotoxin M | 316 | 515 |
| | | | PF03944 | Endotoxin C | 535 | 698 |
| APG00075 modified | SEQ ID NO: 104 | Alternate start | PF05431 | Toxin 10 | 276 | 471 |
| APG00085 modified | SEQ ID NO: 105 | Alternate start | PF03945 | Endotoxin N | 71 | 293 |
| | | | PF00555 | Endotoxin M | 298 | 509 |
| | | | PF03944 | Endotoxin C | 519 | 657 |
| | | | PF14200 | Ricin B Lectin 2 | 696 | 804 |
| APG00085 modified | SEQ ID NO: 106 | Alternate start and 3' Truncation | PF03945 | Endotoxin N | 71 | 293 |
| | | | PF00555 | Endotoxin M | 298 | 509 |
| | | | PF03944 | Endotoxin C | 519 | 656 |
| APG00087 modified | SEQ ID NO: 107 | Alternate start | PF03945 | Endotoxin N | 29 | 265 |
| | | | PF00555 | Endotoxin M | 270 | 461 |
| | | | PF03944 | Endotoxin C | 471 | 608 |
| APG00090 modified | SEQ ID NO: 108 | Alternate start | PF00652 | Ricin B Lectin | 37 | 164 |
| | | | PF05431 | Toxin 10 | 174 | 372 |
| APG00094 modified | SEQ ID NO: 109 | Alternate start | PF03945 | Endotoxin N | 44 | 294 |
| | | | PF00555 | Endotoxin M | 301 | 408 |
| | | | PF03944 | Endotoxin C | 500 | 636 |
| APG00094 modified | SEQ ID NO: 110 | Alternate start and 3' Truncation | PF03945 | Endotoxin N | 44 | 294 |
| | | | PF00555 | Endotoxin M | 301 | 408 |
| | | | PF03944 | Endotoxin C | 500 | 635 |
| APG00097 modified | SEQ ID NO: 111 | Alternate start | PF03945 | Endotoxin N | 72 | 330 |
| | | | PF03944 | Endotoxin C | 561 | 721 |
| APG00097 modified | SEQ ID NO: 112 | Alternate start and 3' Truncation | PF03945 | Endotoxin N | 72 | 330 |
| | | | PF03944 | Endotoxin C | 561 | 720 |
| APG00104 modified | SEQ ID NO: 113 | Alternate start | PF12495 | Vip3A N | 14 | 186 |
| | | | PF02018 | CBM 4 9 | 542 | 667 |
| APG00114 modified | SEQ ID NO: 114 | Alternate start | PF03945 | Endotoxin N | 51 | 298 |
| | | | PF00030 | Crystall | 727 | 807 |
| APG00115 modified | SEQ ID NO: 115 | Alternate start | PF03945 | Endotoxin N | 66 | 278 |
| | | | PF03945 | Endotoxin N | 296 | 356 |
| | | | PF00555 | Endotoxin M | 361 | 579 |
| | | | PF03944 | Endotoxin C | 589 | 721 |
| APG00115 modified | SEQ ID NO: 116 | Alternate start and 3' Truncation | PF03945 | Endotoxin N | 66 | 278 |
| | | | PF03945 | Endotoxin N | 294 | 356 |
| | | | PF00555 | Endotoxin M | 361 | 579 |
| | | | PF03944 | Endotoxin C | 589 | 720 |
| APG00120 modified | SEQ ID NO: 117 | Alternate start | PF03945 | Endotoxin N | 61 | 270 |
| | | | PF03945 | Endotoxin N | 300 | 340 |
| | | | PF00555 | Endotoxin M | 347 | 553 |
| | | | PF03944 | Endotoxin C | 563 | 702 |
| APG00120 modified | SEQ ID NO: 118 | Alternate start and 3' Truncation | PF03945 | Endotoxin N | 61 | 270 |
| | | | PF03945 | Endotoxin N | 300 | 340 |
| | | | PF00555 | Endotoxin M | 347 | 553 |
| | | | PF03944 | Endotoxin C | 563 | 701 |
| APG00162 modified | SEQ ID NO: 119 | Alternate start | PF03945 | Endotoxin N | 73 | 316 |
| | | | PF00555 | Endotoxin M | 321 | 519 |
| | | | PF03944 | Endotoxin C | 529 | 675 |
| APG00162 modified | SEQ ID NO: 120 | Alternate start and 3' Truncation | PF03945 | Endotoxin N | 73 | 316 |
| | | | PF00555 | Endotoxin M | 321 | 519 |
| | | | PF03944 | Endotoxin C | 529 | 674 |

TABLE 2-continued

Summary of PFAM domains in each of SEQ ID NOs: 1-159

| APG ID | SEQ ID NO | Modification Type | PFAM domain | Domain Description | Domain positions Start | Stop |
|---|---|---|---|---|---|---|
| APG00204 modified | SEQ ID NO: 121 | Alternate start | PF03945 | Endotoxin N | 54 | 286 |
| | | | PF00555 | Endotoxin M | 291 | 490 |
| | | | PF03944 | Endotoxin C | 500 | 629 |
| APG00204 modified | SEQ ID NO: 122 | Alternate start and 3' Truncation | PF03945 | Endotoxin N | 54 | 286 |
| | | | PF00555 | Endotoxin M | 291 | 490 |
| | | | PF03944 | Endotoxin C | 500 | 628 |
| APG00489 | SEQ ID NO: 123 | | PF03318 | ETX MTX2 | 33 | 298 |
| APG00489 modified | SEQ ID NO: 124 | Signal Peptide removed | PF03318 | ETX MTX2 | 16 | 272 |
| APG00497 | SEQ ID NO: 125 | | PF03945 | Endotoxin N | 62 | 315 |
| | | | PF00555 | Endotoxin M | 320 | 520 |
| | | | PF03944 | Endotoxin C | 533 | 677 |
| APG00497 modified | SEQ ID NO: 126 | 3' Truncation | PF03945 | Endotoxin N | 62 | 315 |
| | | | PF00555 | Endotoxin M | 320 | 520 |
| | | | PF03944 | Endotoxin C | 533 | 676 |
| APG00511 | SEQ ID NO: 127 | | PF03945 | Endotoxin N | 68 | 320 |
| | | | PF00555 | Endotoxin M | 327 | 512 |
| | | | PF03944 | Endotoxin C | 522 | 662 |
| APG00511 modified | SEQ ID NO: 128 | Alternate start | PF03945 | Endotoxin N | 63 | 315 |
| | | | PF00555 | Endotoxin M | 322 | 507 |
| | | | PF03944 | Endotoxin C | 517 | 657 |
| APG00520 | SEQ ID NO: 129 | | PF03945 | Endotoxin N | 61 | 289 |
| | | | PF00555 | Endotoxin M | 294 | 523 |
| | | | PF03944 | Endotoxin C | 533 | 670 |
| APG00520 modified | SEQ ID NO: 130 | 3' Truncation | PF03945 | Endotoxin N | 61 | 289 |
| | | | PF00555 | Endotoxin M | 294 | 523 |
| | | | PF03944 | Endotoxin C | 533 | 669 |
| APG00544 | SEQ ID NO: 131 | | PF03945 | Endotoxin N | 61 | 289 |
| | | | PF00555 | Endotoxin M | 294 | 523 |
| | | | PF03944 | Endotoxin C | 533 | 670 |

Variants of SEQ ID NO: 8 comprise SEQ ID NOs: 9, 123 and 124. FIG. 1 provides an amino acid sequence alignment of SEQ ID NOS: 8, 9, 123 and 124, and Table 3 provides a summary of the type of modification and percent sequence identity SEQ ID NOs: 9, 123 and 124 share with SEQ ID NO: 8.

Figure 2:
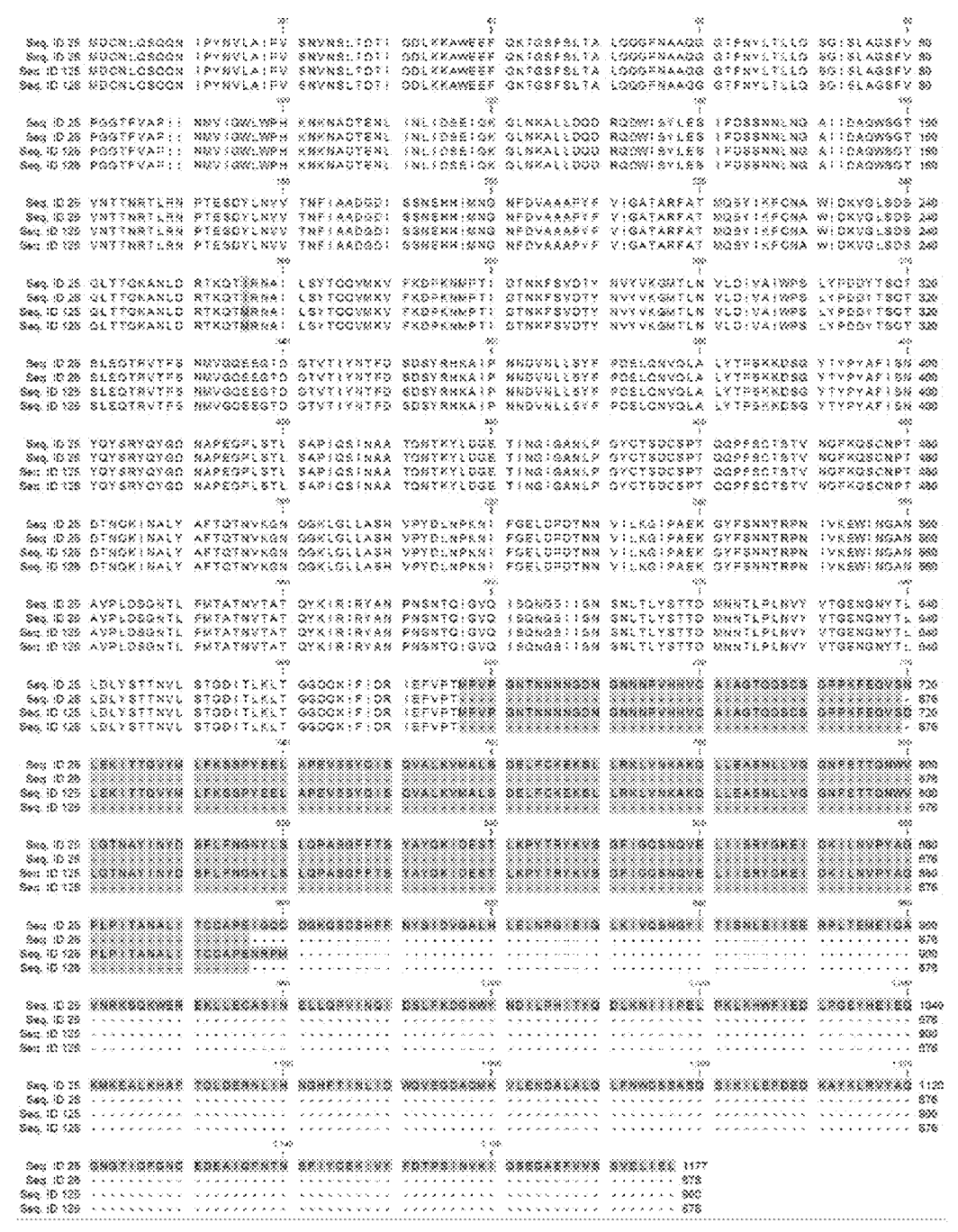

Variants of SEQ ID NO: 25 comprise SEQ ID NOs: 26, 125 and 126. FIG. 2 provides an amino acid sequence alignment of SEQ ID NOs: 25, 26, 125 and 126, and Table 3 provides a summary of the type of modification and percent sequence identity SEQ ID NOs: 26, 125 and 126 share with SEQ ID NO: 25.

Figure 3:
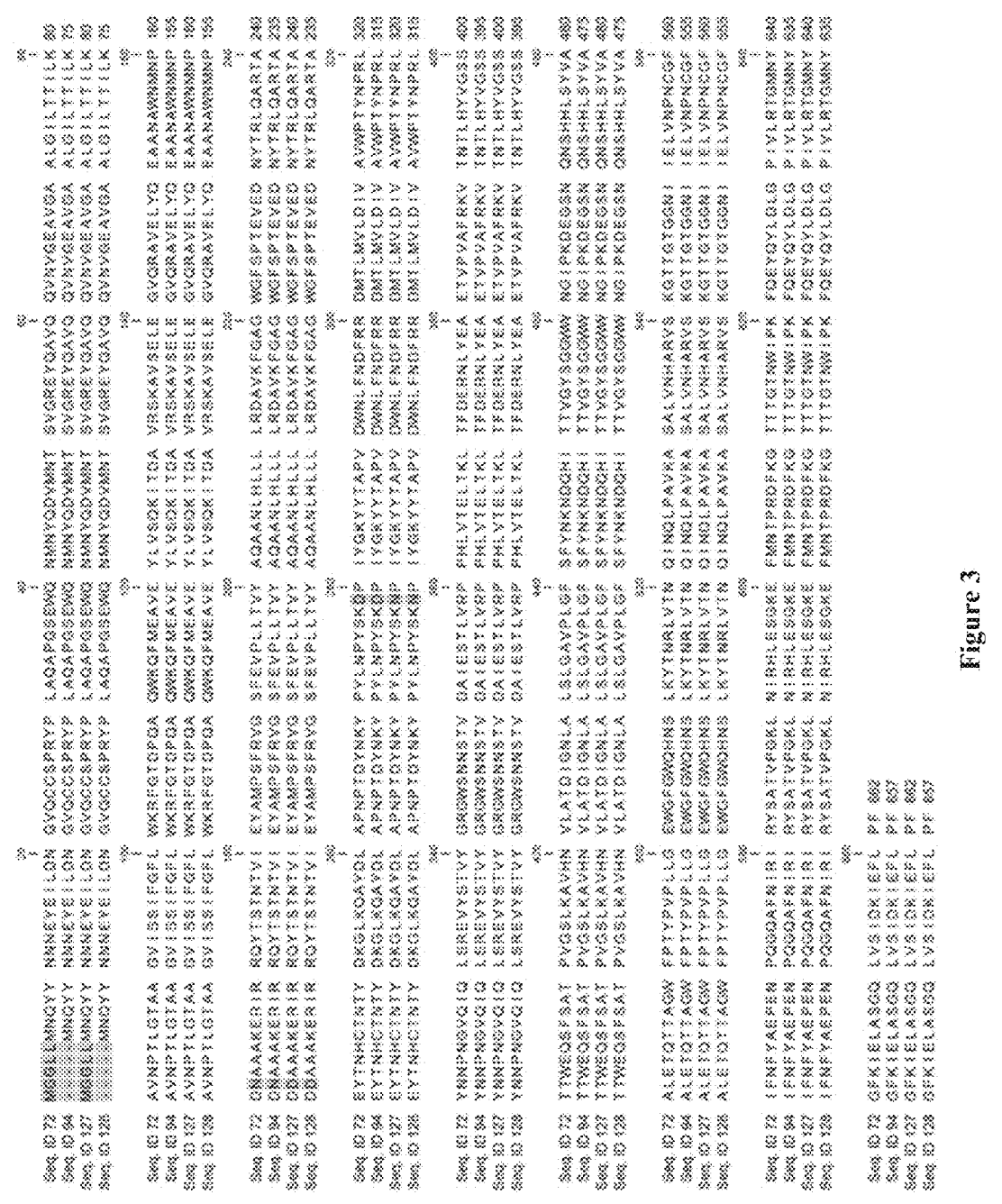

Variants of SEQ ID NO: 72 comprise SEQ ID NOs: 94, 127 and 128. FIG. 3 provides an amino acid sequence alignment of SEQ ID NOs: 72, 94, 127 and 128, and Table 3 provides a summary of the type of modification and percent sequence identity SEQ ID NOs: 94, 127 and 128 share with SEQ ID NO: 72.

Figure 4:
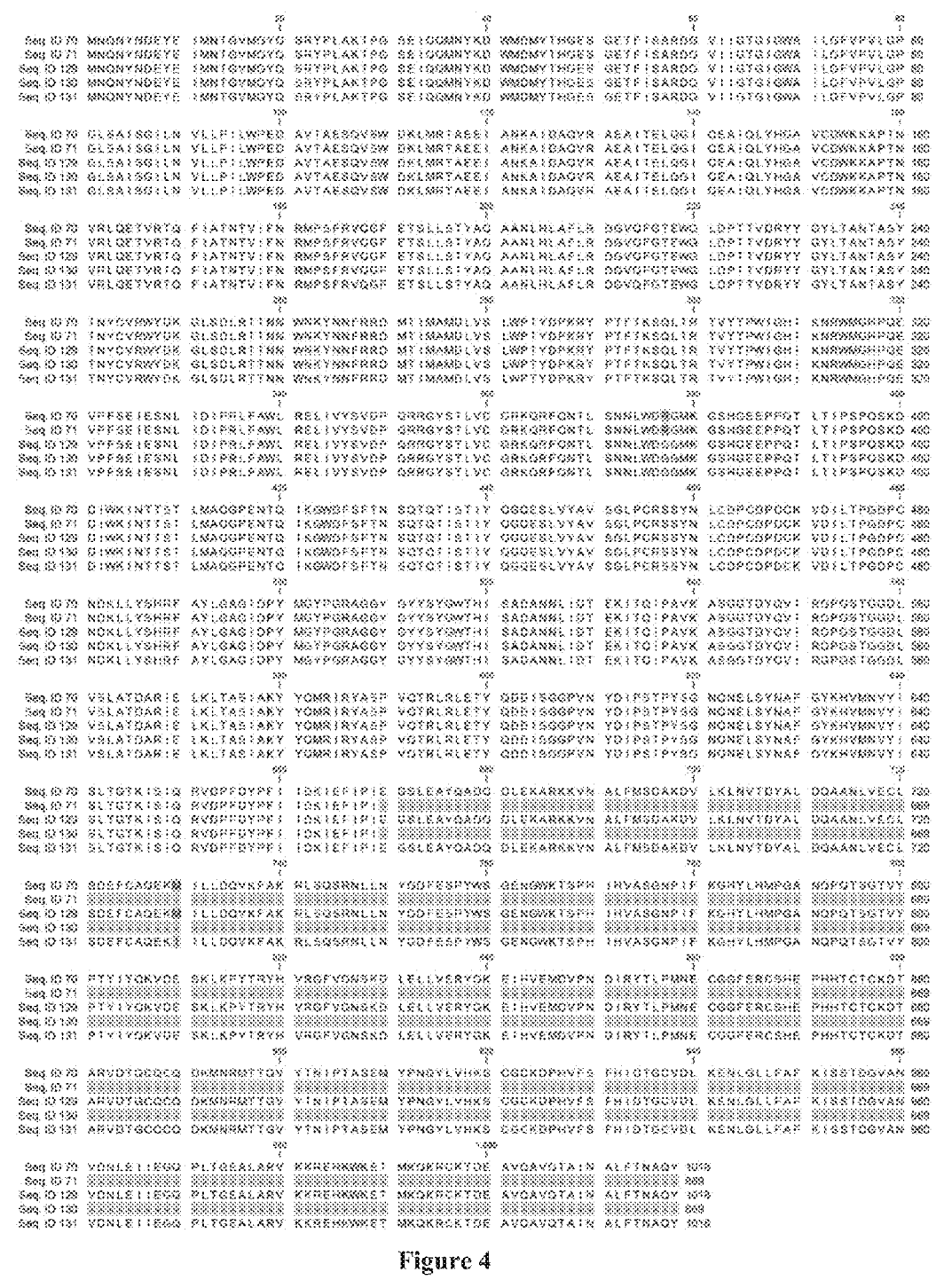

Variants of SEQ ID NO: 70 comprise SEQ ID NOs: 71, 129, 130, and 131. FIG. 4 provides an amino acid sequence alignment of SEQ ID NOs: 70, 71, 129, 130, and 131. Table 3 provides a summary of the type of modification and percent sequence identity SEQ ID NOs: 71, 129, 130, and 131 share with SEQ ID NO: 70.

TABLE 3

Summary of Variants for SEQ ID NOs: 8, 25, 72, and 70

| Related Gene Family | | | | | % identity to SEQ ID |
|---|---|---|---|---|---|
| Gene Name | SEQ ID No. | Gene Name | SEQ ID No. | Modification Type | NOs: 8, 25 and 72 |
| APG00010 | 8 | APG00489 | 123 | | 99.06 |
| | | APG00489 modified | 124 | Removed Signal Peptide | 99.31 |
| APG00052 | 25 | APG00497 | 125 | | 99.33 |
| | | APG00497 modified | 126 | 3' Truncation | 99.85 |
| APG00130 | 72 | APG00511 | 127 | | 99.70 |
| | | APG00511 modified | 128 | Alternate start | 99.70 |
| APG00124 | 70 | APG00520 | 129 | | 99.90 |
| | | APG00520 modified | 130 | 3' Truncation | 99.85 |
| | | APG00544 | 131 | | 99.80 |
| APG00008 | 6 | APG00573 | 132 | | 86.71 |
| | | APG00573 modified | 133 | Alternate start | 86.71 |
| | | APG00605 | 134 | | 98.73 |

TABLE 3-continued

Summary of Variants for SEQ ID NOs: 8, 25, 72, and 70

| Related Gene Family | | | | % identity to SEQ ID NOs: 8, 25 and 72 |
|---|---|---|---|---|
| Gene Name | SEQ ID No. | Gene Name | SEQ ID No. | Modification Type |
| | | APG00605 modified | 135 | Alternate start | 98.58 |
| | | APG00620 | 136 | | 98.58 |
| | | APG00620 modified | 137 | Alternate start | 98.42 |
| | | APG00640 | 138 | | 88.13 |
| | | APG00725 | 139 | | 98.26 |
| | | APG00725 modified | 140 | Alternate start | 98.10 |
| | | APG00730 | 141 | | 99.68 |
| | | APG00730 modified | 142 | Alternate start | 99.53 |
| | | APG00490 | 143 | | 94.07 |
| | | APG00490 modified | 144 | Alternate start | 93.86 |
| | | APG00512 | 145 | | 94.30 |
| | | APG00512 modified | 146 | Alternate start | 94.15 |
| | | APG00525 | 147 | | 98.10 |
| | | APG00525 modified | 148 | Alternate start | 97.94 |
| | | APG00539 | 149 | | 86.87 |
| | | APG00539 modified | 150 | Alternate start | 86.87 |
| | | APG00554 | 151 | | 93.51 |
| | | APG00554 modified | 152 | Alternate start | 93.35 |
| | | APG00567 | 153 | | 99.84 |
| | | APG00567 modified | 154 | Alternate start | 99.68 |
| | | APG00575 | 155 | | 87.66 |
| | | APG00604 | 156 | | 94.15 |
| | | APG00604 modified | 157 | Alternate start | 93.99 |
| | | APG00621 | 158 | | 95.09 |
| | | APG00621 modified | 159 | Alternate start | 94.94 |

Figure 5C:
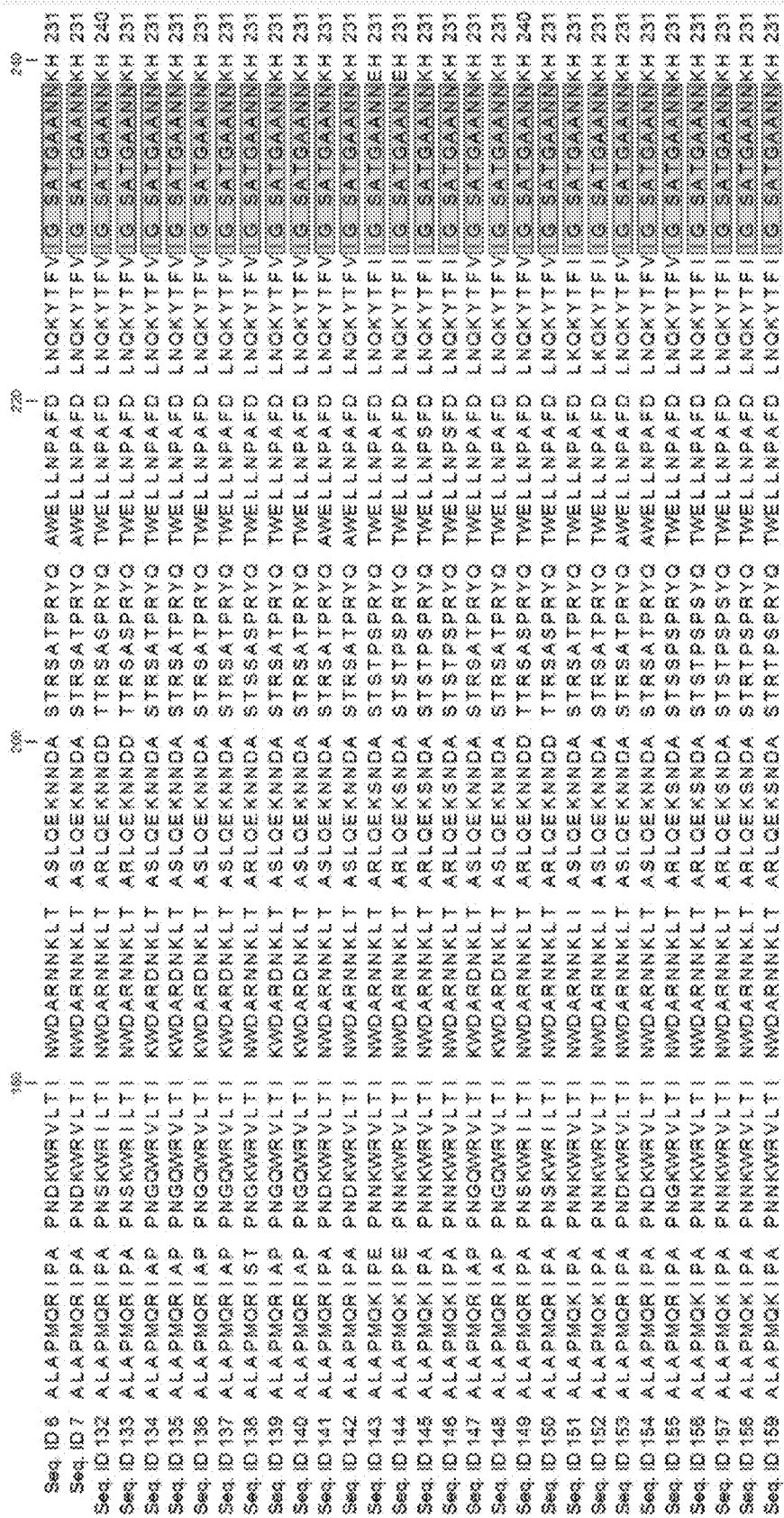
Figure 5E:
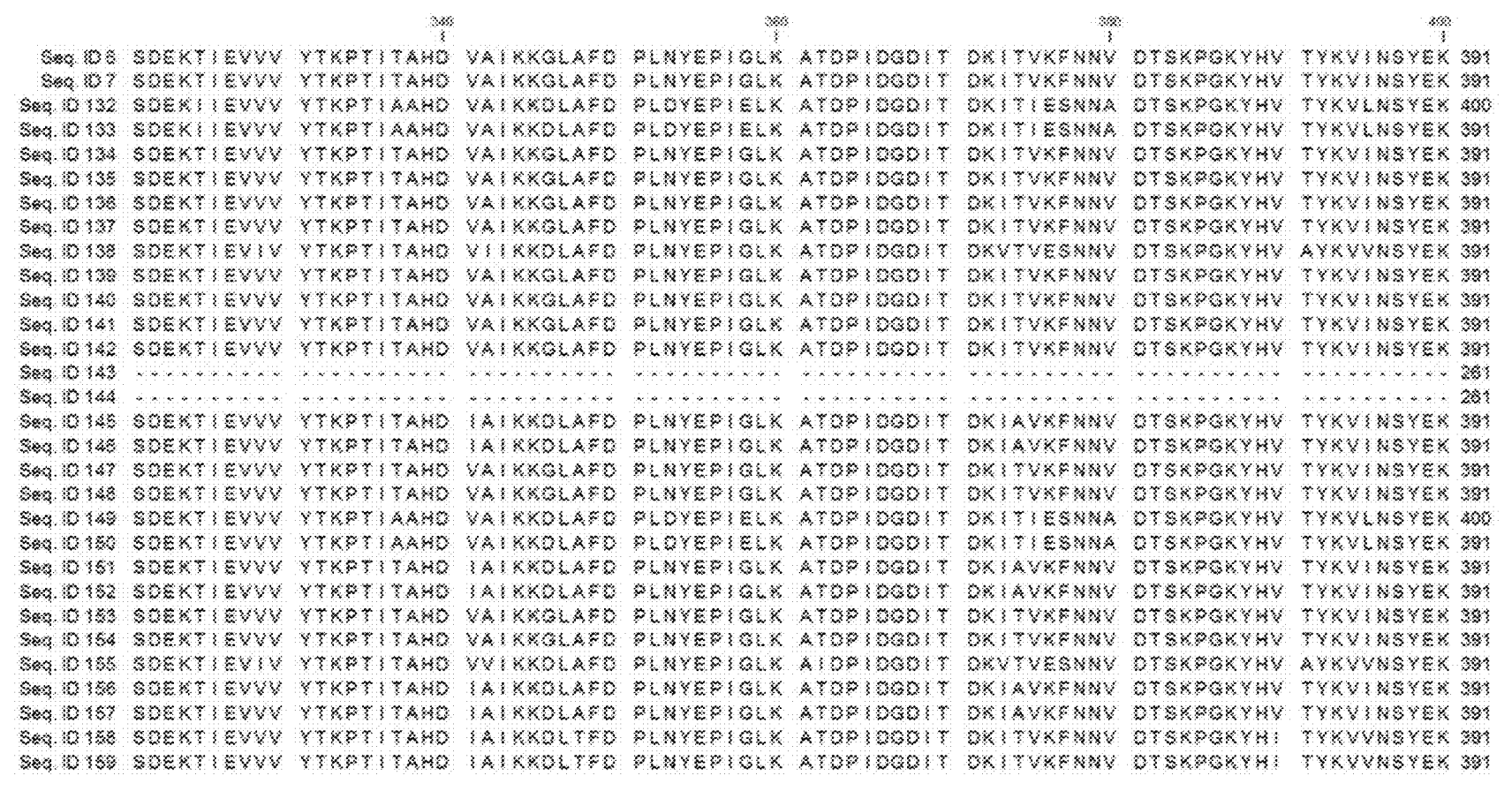
Figure 5H:
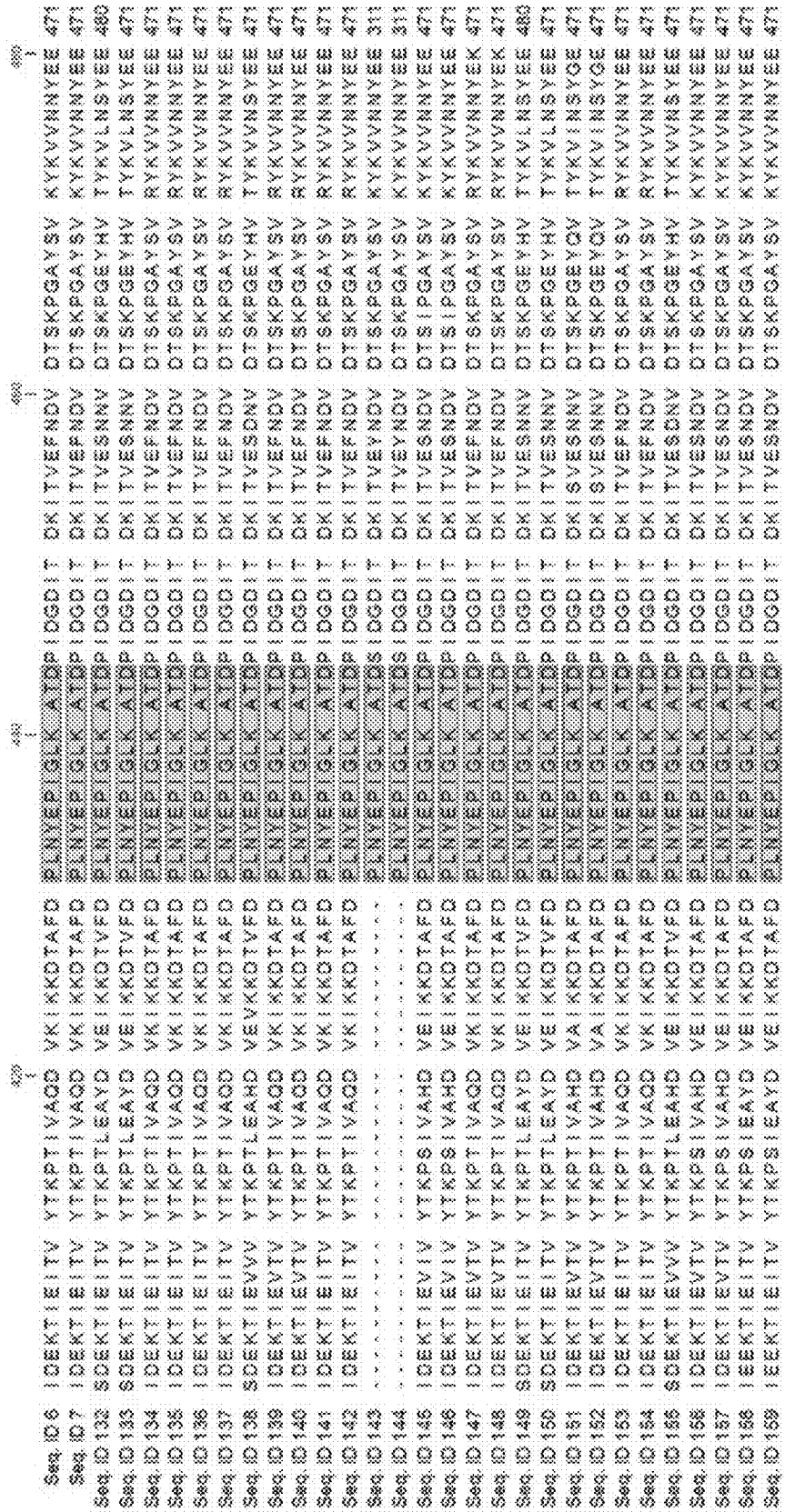
Figure 5G:
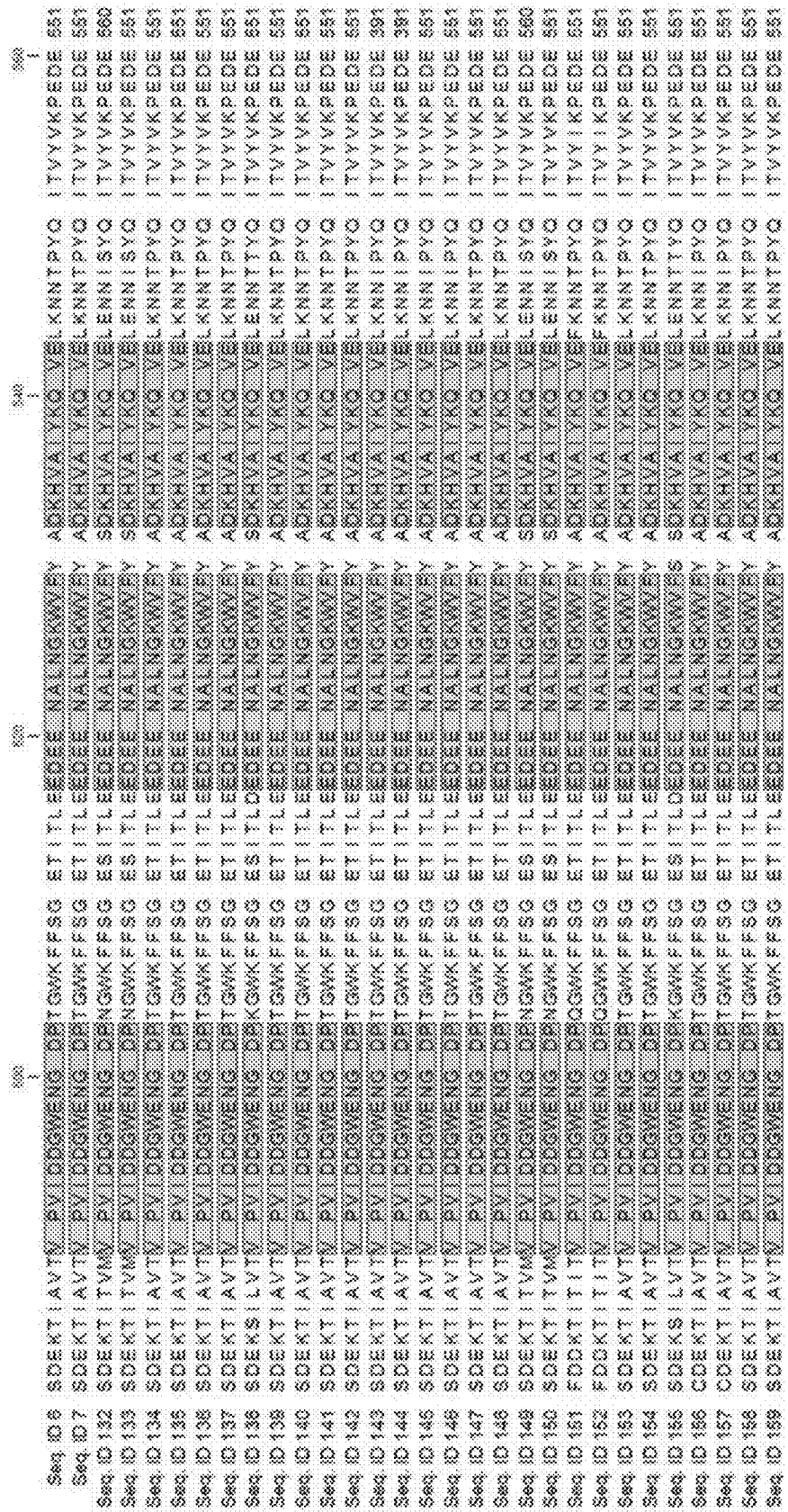

As noted in FIGS. 5A-5H, each of SEQ ID NOs: 6, 132, 133, 134, 135, 136, 137, 138, 139, 140, 141, 142, 143, 144, 145, 146, 147, 148, 149, 150, 151, 152, 153, 154, 155, 156, 157, 158, and 159 share common motifs as denoted below in Table 4. FIGS. 5A-5H indicate where each of the conserved sequences is found in each of SEQ ID NOs: 6 and 132-159.

TABLE 4

Conserved regions in SEQ ID NOs: 6 and 132-159

| Conserved Sequence | SEQ ID NO: |
|---|---|
| ICSINGSAKFDPNTN | 161 |
| NSQAGAIAGKTA | 162 |
| IGSATGAANN | 163 |
| PLNYEPIGLKATD | 164 |
| VPVIDDGWENGDP | 165 |
| EDEENALNGKWVF | 166 |
| DKHVAIYKQVE | 167 |

In specific embodiments, the active variant comprising SEQ ID NOs: 6 or 132-159 can comprise at least 70%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to any one of SEQ ID NOs: 6 and 132-159 and further comprises at least one of the conserved domains set forth in Table 4. For example, in one embodiment, the active variant will comprise at least 70%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NOs: 6 or 132-159, and further comprise one or more amino acid domains set forth in Table 4 (that is at least one of SEQ ID NOS: 161, 162, 163, 164, 165, 166, and/or 167). In a non-limiting embodiment, the active variant comprises at least 70%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NOs: 6 or 132-159, and further comprises SEQ ID NO: 166. In another embodiment, an active variant of SEQ ID NOs: 6 or 132-159 comprises a sequence having at least 70%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NOs: 6 or 132-159, wherein the active variant is not SEQ ID NO: 160.

Figure 6:
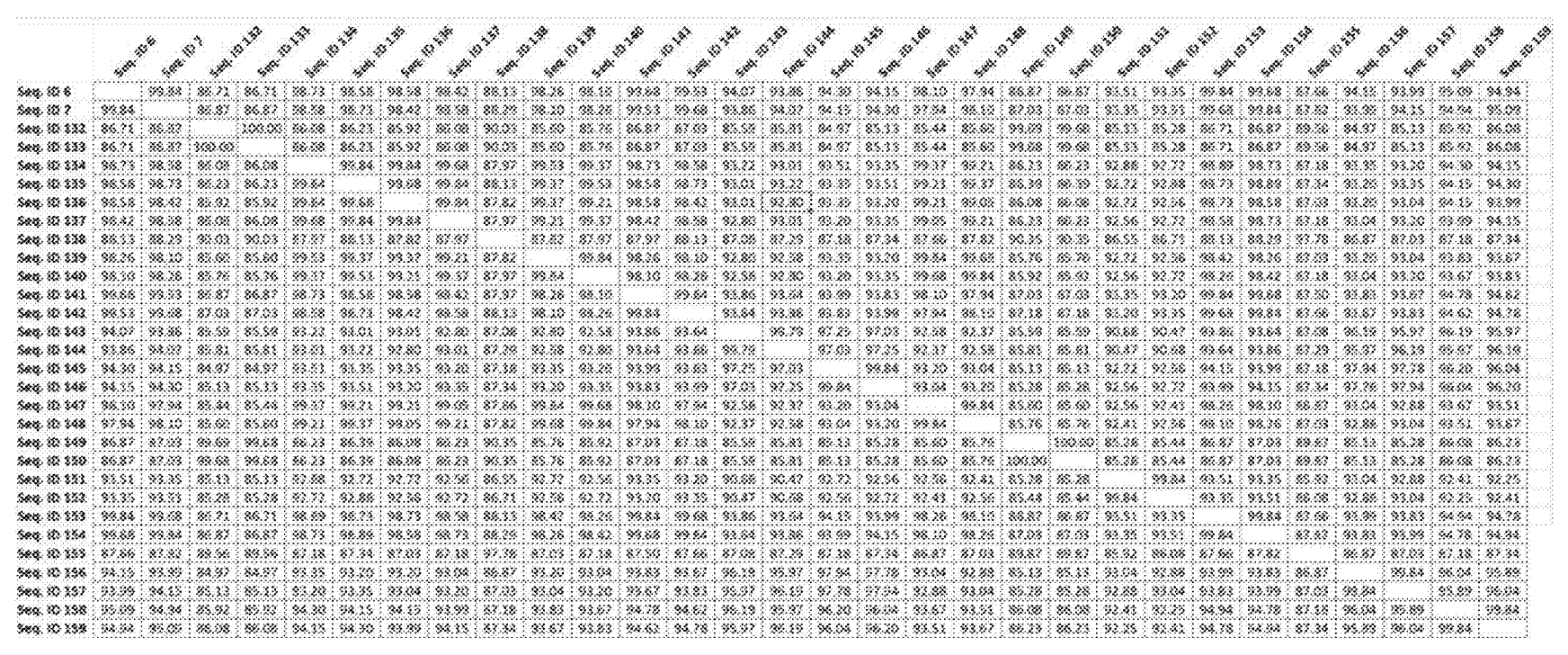

FIG. 6 provides the percent sequence identity relationship between SEQ ID NOs: 6, 132, 133, 134, 135, 136, 137, 138, 139, 140, 141, 142, 143, 144, 145, 146, 147, 148, 149, 150, 151, 152, 153, 154, 155, 156, 157, 158, and 159.

Recombinant or synthetic nucleic acids encoding the pesticidal polypeptides disclosed herein are also provided. Of particular interest are nucleic acid sequences that have been designed for expression in a plant of interest. For example, the nucleic acid sequence can be optimized for increased expression in a host plant. A pesticidal protein as provided herein may be back-translated to produce a nucleic acid comprising codons optimized for expression in a particular host, for example, a crop plant. In another embodiment, the polynucleotides encoding the polypeptides provided herein may be optimized for increased expression in the transformed plant. For example, the polynucleotides can be synthesized using plant-preferred codons for improved expression. See, for example, Campbell and Gowri (1990) *Plant Physiol.* 92:1-11 for a discussion of host-preferred codon usage. Methods are available in the art for synthesizing plant-preferred genes. See, for example, U.S. Pat.

Nos. 5,380,831 and 5,436,391, and Murray et al. (1989) *Nucleic Acids Res.* 17:477-498, each of which is herein incorporated by reference. Expression of such a coding sequence by the transformed plant (for example, dicot or monocot) will result in the production of a pesticidal polypeptide and confer increased resistance in the plant to a pest. Recombinant and synthetic nucleic acid molecules encoding the pesticidal proteins of the invention do not include the naturally occurring bacterial sequence encoding the protein.

A "recombinant polynucleotide" or "recombinant nucleic acid" comprises a combination of two or more chemically linked nucleic acid segments which are not found directly joined in nature. By "directly joined" is intended the two nucleic acid segments are immediately adjacent and joined to one another by a chemical linkage. In specific embodiments, the recombinant polynucleotide comprises a polynucleotide of interest or a variant or fragment thereof such that an additional chemically linked nucleic acid segment is located either 5', 3' or internal to the polynucleotide of interest. Alternatively, the chemically-linked nucleic acid segment of the recombinant polynucleotide can be formed by deletion of a sequence. The additional chemically linked nucleic acid segment, or the sequence deleted to join the linked nucleic acid segments, can be of any length, including for example, 1, 2, 3, 4, 5, 6, 7, 8, 9, 10, 15, 20 nucleotides or more. Various methods for making such recombinant polynucleotides include chemical synthesis, and the manipulation of isolated segments of polynucleotides by genetic engineering techniques. In specific embodiments, the recombinant polynucleotide can comprise a recombinant DNA sequence or a recombinant RNA sequence. A "fragment of a recombinant polynucleotide or nucleic acid" comprises at least one of a combination of two or more chemically linked amino acid segments that are not found directly joined in nature.

Fragments of a polynucleotide (RNA or DNA) may encode protein fragments that retain activity. In specific embodiments, a fragment of a recombinant polynucleotide or a recombinant polynucleotide construct comprises at least one junction of the two or more chemically linked or operably linked nucleic acid segments which are not found directly joined in nature. A fragment of a polynucleotide that encodes a biologically active portion of a polypeptide that retains pesticidal activity will encode at least 25, 30, 40, 50, 60, 70, 75, 80, 90, 100, 110, 120, 125, 130, 140, 150, 160, 170, 175, or 180 contiguous amino acids, or up to the total number of amino acids present in a full-length polypeptide as set forth in SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, and/or 159. In specific embodiments, such polypeptide fragments are active fragments. In some embodiments, the polypeptide fragment comprises a recombinant polypeptide fragment. As used herein, a fragment of a recombinant polypeptide comprises at least one of a combination of two or more chemically linked amino acid segments which are not found directly joined in nature.

The term "variants" as used herein is intended to mean substantially similar sequences. For polynucleotides, a variant comprises a deletion and/or addition of one or more nucleotides at one or more internal sites within the native polynucleotide and/or a substitution of one or more nucleotides at one or more sites in the native polynucleotide. As used herein, a "native" polynucleotide or polypeptide comprises a naturally occurring nucleotide sequence or amino acid sequence, respectively.

Variants of a particular polynucleotide of the invention (i.e., the reference polynucleotide) can also be evaluated by comparison of the polypeptide encoded by a variant polynucleotide and the polypeptide encoded by the reference polynucleotide to determine the percent sequence identity between the two. Thus, for example, an isolated polynucleotide that encodes a polypeptide with a given percent sequence identity to the polypeptide of SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, and/or 159 are disclosed. Percent sequence identity between any two polypeptides can be calculated using sequence alignment programs and parameters described elsewhere herein. Where any given pair of polynucleotides of the invention is evaluated by comparison of the percent sequence identity shared by the two polypeptides they encode, the percent sequence identity between the two encoded polypeptides is at least about 40%, 45%, 50%, 55%, 60%, 65%, 70%, 75%, 80%, 85%, 86%, 87%, 88%, 89%, 90%, 91%, 92%, 93%, 94%, 95%, 96%, 97%, 98%, 99% or more sequence identity to SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, and/or 159. In other embodiments, the variant of the polynucleotide provided herein differs from the native sequence by at least 1, 2, 3, 4, 5, 6, 7, 8, 9, 10 or more nucleotides.

iii. Sequence Comparisons

As used herein, the term "identity" or "percent identity" when used with respect to a particular pair of aligned amino acid sequences, refers to the percent amino acid sequence identity that is obtained by counting the number of identical matches in the alignment and dividing such number of identical matches by the length of the aligned sequences. As used herein, the term "similarity" or "percent similarity" when used with respect to a particular pair of aligned amino acid sequences, refers to the sum of the scores that are obtained from a scoring matrix for each amino acid pair in the alignment divided by the length of the aligned sequences.

Unless otherwise stated, identity and similarity is calculated by the Needleman-Wunsch global alignment and scoring algorithms (Needleman and Wunsch (1970) *J. Mol. Biol.*

48(3):443-453) as implemented by the "needle" program, distributed as part of the EMBOSS software package (Rice, P. Longden, I. and Bleasby, A., EMBOSS: The European Molecular Biology Open Software Suite, 2000, *Trends in Genetics* 16, (6) pp. 276-277, versions 6.3.1 available from EMBnet at embnet.org/resource/emboss and emboss.sourceforge.net, among other sources) using default gap penalties and scoring matrices (EBLOSUM62 for protein and EDNAFULL for DNA). Equivalent programs may also be used. By "equivalent program" is intended any sequence comparison program that, for any two sequences in question, generates an alignment having identical nucleotide residue matches and an identical percent sequence identity when compared to the corresponding alignment generated by needle from EMBOSS version 6.3.1.

Additional mathematical algorithms are known in the art and can be utilized for the comparison of two sequences. See, for example, the algorithm of Karlin and Altschul (1990) Proc. Natl. Acad. Sci. USA 87:2264, modified as in Karlin and Altschul (1993) Proc. Natl. Acad. Sci. USA 90:5873-5877. Such an algorithm is incorporated into the BLAST programs of Altschul et al. (1990) J. Mol. Biol. 215:403. BLAST nucleotide searches can be performed with the BLASTN program, to obtain nucleotide sequences homologous to pesticidal-like nucleic acid molecules of the invention. BLAST protein searches can be performed with the BLASTP program to obtain amino acid sequences homologous to pesticidal protein molecules of the invention. To obtain gapped alignments for comparison purposes, Gapped BLAST (in BLAST 2.0) can be utilized as described in Altschul et al. (1997) *Nucleic Acids Res.* 25:3389. Alternatively, PSI-Blast can be used to perform an iterated search that detects distant relationships between molecules. See Altschul et al. (1997) supra. When utilizing BLAST, Gapped BLAST, and PSI-Blast programs, the default parameters of the respective programs (e.g., BLASTX and BLASTN) can be used. Alignment may also be performed manually by inspection.

Two sequences are "optimally aligned" when they are aligned for similarity scoring using a defined amino acid substitution matrix (for example, BLOSUM62), gap existence penalty and gap extension penalty so as to arrive at the highest score possible for that pair of sequences. Amino acid substitution matrices and their use in quantifying the similarity between two sequences are well-known in the art and described, for example, in Dayhoff et al. (1978) "A model of evolutionary change in proteins." In "Atlas of Protein Sequence and Structure," Vol. 5, Suppl. 3 (ed. M. O. Dayhoff), pp. 345-352. Natl. Biomed. Res. Found., Washington, D.C. and Henikoff et al. (1992) Proc. Natl. Acad. Sci. USA 89:10915-10919. The BLOSUM62 matrix is often used as a default scoring substitution matrix in sequence alignment protocols. The gap existence penalty is imposed for the introduction of a single amino acid gap in one of the aligned sequences, and the gap extension penalty is imposed for each additional empty amino acid position inserted into an already opened gap. The alignment is defined by the amino acids positions of each sequence at which the alignment begins and ends and, optionally, by the insertion of a gap or multiple gaps in one or both sequences, so as to arrive at the highest possible score. While optimal alignment and scoring can be accomplished manually, the process is facilitated by the use of a computer-implemented alignment algorithm, such as, for example, gapped BLAST 2.0, described in Altschul et al. (1997) *Nucleic Acids Res.* 25:3389-3402, and made available to the public at the National Center for Biotechnology Information Website (www.ncbi.nlm.nih.gov). Optimal alignments, including multiple alignments, can be prepared using, for example, PSI-BLAST, available through www.ncbi.nlm.nih.gov and described by Altschul et al. (1997) *Nucleic Acids Res.* 25:3389-3402.

With respect to an amino acid sequence that is optimally aligned with a reference sequence, an amino acid residue "corresponds to" the position in the reference sequence with which the residue is paired in the alignment. The "position" is denoted by a number that sequentially identifies each amino acid in the reference sequence based on its position relative to the N-terminus. For example, in SEQ ID NO: 1, position 1 is M, position 2 is A, position 3 is N, etc. When a test sequence is optimally aligned with SEQ ID NO: 1, a residue in the test sequence that aligns with the N at position 3 is said to "correspond to position 3" of SEQ ID NO: 1. Owing to deletions, insertion, truncations, fusions, etc., that must be taken into account when determining an optimal alignment, in general the amino acid residue number in a test sequence as determined by simply counting from the N-terminal will not necessarily be the same as the number of its corresponding position in the reference sequence. For example, in a case where there is a deletion in an aligned test sequence, there will be no amino acid that corresponds to a position in the reference sequence at the site of deletion. Where there is an insertion in an aligned reference sequence, that insertion will not correspond to any amino acid position in the reference sequence. In the case of truncations or fusions there can be stretches of amino acids in either the reference or aligned sequence that do not correspond to any amino acid in the corresponding sequence.

iv. Antibodies

Antibodies to the polypeptides of the present invention, or to variants or fragments thereof, are also encompassed. Methods for producing antibodies are well known in the art (see, for example, Harlow and Lane (1988) Antibodies: A Laboratory Manual, Cold Spring Harbor Laboratory, Cold Spring Harbor, N.Y.; and U.S. Pat. No. 4,196,265). These antibodies can be used in kits for the detection and isolation of toxin polypeptides. Thus, this disclosure provides kits comprising antibodies that specifically bind to the polypeptides described herein, including, for example, polypeptides having the sequence of SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, and/or 159.

II. Pests

The compositions and methods provided herein are useful against a variety of pests. "Pests" includes but is not limited to, insects, fungi, bacteria, nematodes, acarids, protozoan pathogens, animal-parasitic liver flukes, and the like. Pests of particular interest are insect pests, particularly insect pests that cause significant damage to agricultural plants. Insect pests include insects selected from the orders Coleoptera, Diptera, Hymenoptera, Lepidoptera, Mallophaga, Homoptera, Hemiptera, Orthroptera, Thysanoptera, Dermaptera, Isoptera, Anoplura, Siphonaptera, Trichoptera, or nematodes. In non-limiting embodiments, the insect pest comprises Western corn rootworm, *Diabrotica virgifera vir-* gifera; Fall armyworm, *Spodoptera frugiperda*; Colorado potato beetle, *Leptinotarsa decemlineata*; Corn earworm, *Helicoverpa zea* (in North America same species attacks cotton and called cotton bollworm); European corn borer, *Ostrinia nubilalis*; Black cutworm, *Agrotis ipsilon*; Diamondback moth, *Plutella xylostella*; Velvetbean caterpillar, *Anticarsia gemmatalis*; Southwestern corn borer, *Diatraea grandiosella*; Cotton bollworm, *Helicoverpa armigera* (found other than USA in rest of the world); Southern green stinkbug, *Nezara viridula*; Green stinkbug, *Chinavia halaris*; Brown marmorated stinkbug, *Halyomorpha halys*; and Brown stinbug, *Euschistus servus*. In other embodiments, the pest comprises a nematode including, but not limited to, *Meloidogyne hapla* (Northern root-knot nematode); *Meloidogyne enterolobii, Meloidogyne arenaria* (peanut root-knot nematode); and *Meloidogyne javanica*.

The term "insect pests" as used herein refers to insects and other similar pests such as, for example, those of the order Acari including, but not limited to, mites and ticks. Insect pests of the present invention include, but are not limited to, insects of the order Lepidoptera, e.g. *Achoroia grisella, Acleris gloverana, Acleris variana, Adoxophyes orana, Agrotis ipsilon, Alabama argillacea, Alsophila pometaria, Amyelois transitella, Anagasta kuehniella, Anarsia lineatella, Anisota senatoria, Antheraea pernyi, Anticarsia gemmatalis, Archips* sp., *Argyrotaenia* sp., *Athetis mindara, Bombyx mori, Bucculatrix thurberiella, Cadra cautella, Choristoneura* sp., *Cochylls hospes, Colias eurytheme, Corcyra cephalonica, Cydia latiferreanus, Cydia pomonella, Datana integerrima, Dendrolimus sibericus, Desmiafeneralis, Diaphania hyalinata, Diaphania nitidalis, Diatraea grandiosella, Diatraea saccharalis, Ennomos subsignaria, Eoreuma loftini, Esphestia elutella, Erannis tilaria, Estigmene acrea, Eulia salubricola, Eupocoellia ambiguella, Eupoecilia ambiguella, Euproctis chrysorrhoea, Euxoa messoria, Galleria mellonella, Grapholita molesta, Harrisina americana, Helicoverpa subflexa, Helicoverpa zea, Heliothis virescens, Hemileuca oliviae, Homoeosoma electellum, Hyphantia cunea, Keiferia lycopersicella, Lambdina fiscellaria fiscellaria, Lambdina fiscellaria lugubrosa, Leucoma salicis, Lobesia botrana, Loxostege sticticalis, Lymantria dispar, Macalla thyrisalis, Malacosoma* sp., *Mamestra brassicae, Mamestra configurata, Manduca quinquemaculata, Manduca sexta, Maruca testulalis, Melanchra picta, Operophtera brumata, Orgyia* sp., *Ostrinia nubilalis, Paleacrita vernata, Papilio cresphontes, Pectinophora gossypiella, Phryganidia californica, Phyllonorycter blancardella, Pieris napi, Pieris rapae, Plathypena scabra, Platynota flouendana, Platynota stultana, Platyptilia carduidactyla, Plodia interpunctella, Plutella xylostella, Pontia protodice, Pseudaletia unipuncta, Pseudoplasia includens, Sabulodes aegrotata, Schizura concinna, Sitotroga cerealella, Spilonta ocellana, Spodoptera* sp., *Thaurnstopoea pityocampa, Tinsola bisselliella, Trichoplusia hi, Udea rubigalis, Xylomyges curiails*, and *Yponomeuta padella*.

Insect pests also include insects selected from the orders Diptera, Hymenoptera, Lepidoptera, Mallophaga, Homoptera, Hemiptera, Orthroptera, Thysanoptera, Dermaptera, Isoptera, Anoplura, Siphonaptera, Trichoptera, Coleoptera.

Insect pests for the major crops include, but are not limited to: Maize: *Ostrinia nubilalis*, European corn borer; *Agrotis ipsilon*, black cutworm; *Helicoverpa zeae*, corn earworm; *Spodoptera frugiperda*, fall armyworm; *Diatraea grandiosella*, southwestern corn borer; *Elasmopalpus lignosellus*, lesser cornstalk borer; *Diatraea saccharalis*, surgarcane borer; western corn rootworm, e.g., *Diabrotica virgifera virgifera*; northern corn rootworm, e.g., *Diabrotica longicornis barberi*; southern corn rootworm, e.g., *Diabrotica undecimpunctata howardi; Melanotus* spp., wireworms; *Cyclocephala borealis*, northern masked chafer (white grub); *Cyclocephala immaculata*, southern masked chafer (white grub); *Popillia japonica*, Japanese beetle; *Chaetocnema pulicaria*, corn flea beetle; *Sphenophorus maidis*, maize billbug; *Rhopalosiphum maidis*, corn leaf aphid; *Anuraphis maidiradicis*, corn root aphid; *Blissus leucopterus leucopterus*, chinch bug; *Melanoplus femurrubrum*, redlegged grasshopper; *Melanoplus sanguinipes*, migratory grasshopper; *Hylemya platura*, seedcorn maggot; *Agromyza parvicornis*, corn blotch leafminer; *Anaphothrips obscrurus*, grass thrips; *Solenopsis milesta*, thief ant; *Tetranychus urticae*, two spotted spider mite; Sorghum: *Chilo partellus*, sorghum borer; *Spodoptera frugiperda*, fall armyworm; *Helicoverpa zea*, corn earworm; *Elasmopalpus lignosellus*, leser cornstalk borer; *Feltia subterranea*, granulate cutworm; *Phyllophaga crinita*, white grub; *Eleodes, Conoderus*, and *Aeolus* spp., wireworms; *Oulema melanopus*, cereal leaf beetle; *Chaetocnema pulicaria*, corn flea beetle; *Sphenophorus maidis*, maize billbug; *Rhopalosiphum maidis*; corn leaf aphid; *Sipha flava*, yellow sugarcane aphid; chinch bug, e.g., *Blissus leucopterus leucopterus; Contarinia sorghicola*, sorghum midge; *Tetranychus cinnabarinus*, carmine spider mite; *Tetranychus urticae*, two-spotted spider mite; Wheat: *Pseudaletia unipunctata*, army worm; *Spodoptera frugiperda*, fall armyworm; *Elasmopalpus lignosellus*, lesser cornstalk borer; *Agrotis orthogonia*, pale western cutworm; *Elasmopalpus lignosellus*, lesser cornstalk borer; *Oulema melanopus*, cereal leaf beetle; *Hypera punctata*, clover leaf weevil; southern corn rootworm, e.g., *Diabrotica undecimpunctata* howardi; Russian wheat aphid; *Schizaphis graminum*, greenbug; *Macrosiphum avenae*, English grain aphid; *Melanoplus femurrubrum*, redlegged grasshopper; *Melanoplus differentialis*, differential grasshopper; *Melanoplus sanguinipes*, migratory grasshopper; *Mayetiola destructor*, Hessian fly; *Sitodiplosis mosellana*, wheat midge; *Meromyza americana*, wheat stem maggot; *Hylemya coarctata*, wheat bulb fly; *Frankliniella fusca*, tobacco thrips; *Cephus cinctus*, wheat stem sawfly; *Aceria tulipae*, wheat curl mite; Sunflower: *Cylindrocupturus adspersus*, sunflower stem weevil; *Smicronyx fulus*, red sunflower seed weevil; *Smicronyx sordidus*, gray sunflower seed weevil; *Suleima helianthana*, sunflower bud moth; *Homoeosoma electellum*, sunflower moth; *Zygogramma exclamationis*, sunflower beetle; *Bothyrus gibbosus*, carrot beetle; *Neolasioptera murtfeldtiana*, sunflower seed midge; Cotton: *Heliothis virescens*, tobacco budworm; *Helicoverpa zea*, cotton bollworm; *Spodoptera exigua*, beet armyworm; *Pectinophora gossypiella*, pink bollworm; boll weevil, e.g., *Anthonomus grandis; Aphis gossypii*, cotton aphid; *Pseudatomoscelis seriatus*, cotton fleahopper; *Trialeurodes abutilonea*, bandedwinged whitefly; *Lygus lineolaris*, tarnished plant bug; *Melanoplus femurrubrum*, redlegged grasshopper; *Melanoplus differentialis*, differential grasshopper; *Thrips tabaci*, onion thrips; *Franklinkiella fusca*, tobacco thrips; *Tetranychus cinnabarinus*, carmine spider mite; *Tetranychus urticae*, two-spotted spider mite; Rice: *Diatraea saccharalis*, sugarcane borer; *Spodoptera frugiperda*, fall armyworm; *Helicoverpa zea*, corn earworm; *Colaspis brunnea*, grape colaspis; *Lissorhoptrus oryzophilus*, rice water weevil; *Sitophilus oryzae*, rice weevil; *Nephotettix nigropictus*, rice leafhoper; chinch bug, e.g., *Blissus leucopterus leucopterus; Acrosternum hilare*, green stink bug; Soybean: *Pseudoplusia includens*, soybean looper; *Anticarsia gemmatalis*, velvetbean caterpillar; *Plathypena scabra*, green cloverworm; *Ostrinia nubilalis*, European corn borer; *Agrotis ipsilon*, black cutworm; *Spodoptera exigua*, beet armyworm; *Heliothis virescens*, tobacco budworm; *Helicoverpa zea*, cotton bollworm; *Epilachna varivestis*, Mexican bean beetle; *Myzus persicae*, green peach aphid; *Empoasca fabae*, potato leafhopper; *Acrosternum hilare*, green stink bug; *Melanoplus femurrubrum*, redlegged grasshopper; *Melanoplus differentialis*, differential grasshopper; *Hylemya platura*, seedcorn maggot; *Sericothrips variabilis*, soybean thrips; *Thrips tabaci*, onion thrips; *Tetranychus turkestani*, strawberry spider mite; *Tetranychus urticae*, two-spotted spider mite; Barley: *Ostrinia nubilalis*, European corn borer; *Agrotis ipsilon*, black cutworm; *Schizaphis graminum*, greenbug; chinch bug, e.g., *Blissus leucopterus leucopterus; Acrosternum hilare*, green stink bug; *Euschistus servus*, brown stink bug; *Jylemya platura*, seedcorn maggot; *Mayetiola destructor*, Hessian fly; *Petrobia latens*, brown wheat mite; Oil Seed Rape: *Vrevicoryne brassicae*, cabbage aphid; *Phyllotreta cruciferae*, crucifer flea beetle; *Phyllotreta striolata*, striped flea beetle; *Phyllotreta nemorum*, striped turnip flea beetle; *Meligethes aeneus*, rapeseed beetle; and the pollen beetles *Meligethes rufimanus, Meligethes nigrescens, Meligethes canadianus*, and *Meligethes viridescens*; Potato: *Leptinotarsa decemlineata*, Colorado potato beetle.

The methods and compositions provided herein may be effective against Hemiptera such as *Lygus hesperus, Lygus lineolaris, Lygus pratensis, Lygus rugulipennis Popp, Lygus pabulinus, Calocoris norvegicus, Orthops compestris, Plesiocoris rugicollis, Cyrtopeltis modestus, Cyrtopeltis notatus, Spanagonicus albofasciatus, Diaphnocoris chlorinonis, Labopidicola allii, Pseudatomoscelis seriatus, Adelphocoris rapidus, Poecilocapsus lineatus, Blissus leucopterus, Nysius ericae, Nysius raphanus, Euschistus servus, Nezara viridula, Eurygaster, Coreidae, Pyrrhocoridae, Tinidae, Blostomatidae, Reduviidae*, and *Cimicidae*. Pests of interest also include *Araecerus fasciculatus*, coffee bean weevil; *Acanthoscelides obtectus*, bean weevil; *Bruchus rufimanus*, broadbean weevil; *Bruchus pisorum*, pea weevil; *Zabrotes subfasciatus*, Mexican bean weevil; *Diabrotica balteata*, banded cucumber beetle; *Cerotoma trifurcata*, bean leaf beetle; *Diabrotica virgifera*, Mexican corn rootworm; *Epitrix cucumeris*, potato flea beetle; *Chaetocnema confinis*, sweet potato flea beetle; *Hypera postica*, alfalfa weevil; *Anthonomus quadrigibbus*, apple curculio; *Sternechus paludatus*, bean stalk weevil; *Hypera brunnipennis*, Egyptian alfalfa weevil; *Sitophilus granaries*, granary weevil; *Craponius inaequalis*, grape curculio; *Sitophilus zeamais*, maize weevil; *Conotrachelus nenuphar*, plum curculio; *Euscepes postfaciatus*, West Indian sweet potato weevil; *Maladera castanea*, Asiatic garden beetle; *Rhizotrogus majalis*, European chafer; *Macrodactylus subspinosus*, rose chafer; *Tribolium confusum*, confused flour beetle; *Tenebrio obscurus*, dark mealworm; *Tribolium castaneum*, red flour beetle; *Tenebrio molitor*, yellow mealworm.

Nematodes include parasitic nematodes such as root-knot, cyst, and lesion nematodes, including *Heterodera* spp., *Meloidogyne* spp., and *Globodera* spp.; particularly members of the cyst nematodes, including, but not limited to, *Heterodera glycines* (soybean cyst nematode); *Heterodera schachtii* (beet cyst nematode); *Heterodera avenae* (cereal cyst nematode); and *Globodera rostochiensis* and *Globodera pailida* (potato cyst nematodes). Lesion nematodes include *Pratylenchus* spp.

Insect pests may be tested for pesticidal activity of compositions of the invention in early developmental stages, e.g., as larvae or other immature forms. The insects may be reared in total darkness at from about 20° C. to about 30° C. and from about 30% to about 70% relative humidity. Bioassays may be performed as described in Czapla and Lang (1990) *J. Econ. Entomol.* 83 (6): 2480-2485. See, also the experimental section herein.

III. Expression Cassettes

Polynucleotides encoding the pesticidal proteins provided herein can be provided in expression cassettes for expression in an organism of interest. The cassette will include 5' and 3' regulatory sequences operably linked to a polynucleotide encoding a pesticidal polypeptide provided herein that allows for expression of the polynucleotide. The cassette may additionally contain at least one additional gene or genetic element to be cotransformed into the organism. Where additional genes or elements are included, the components are operably linked. Alternatively, the additional gene(s) or element(s) can be provided on multiple expression cassettes. Such an expression cassette is provided with a plurality of restriction sites and/or recombination sites for insertion of the polynucleotides to be under the transcriptional regulation of the regulatory regions. The expression cassette may additionally contain a selectable marker gene.

The expression cassette will include in the 5'-3' direction of transcription, a transcriptional and translational initiation region (i.e., a promoter), a pesticidal polynucleotide of the invention, and a transcriptional and translational termination region (i.e., termination region) functional in the organism of interest, i.e., a plant or bacteria. The promoters of the invention are capable of directing or driving expression of a coding sequence in a host cell. The regulatory regions (i.e., promoters, transcriptional regulatory regions, and translational termination regions) may be endogenous or heterologous to the host cell or to each other. As used herein, "heterologous" in reference to a sequence is a sequence that originates from a foreign species, or, if from the same species, is substantially modified from its native form in composition and/or genomic locus by deliberate human intervention. As used herein, a chimeric gene comprises a coding sequence operably linked to a transcription initiation region that is heterologous to the coding sequence.

Convenient termination regions are available from the Ti-plasmid of *A. tumefaciens*, such as the octopine synthase and nopaline synthase termination regions. See also Guerineau et al. (1991) *Mol. Gen. Genet.* 262:141-144; Proudfoot (1991) *Cell* 64:671-674; Sanfacon et al. (1991) *Genes Dev.* 5:141-149; Mogen et al. (1990) *Plant Cell* 2:1261-1272; Munroe et al. (1990) *Gene* 91:151-158; Ballas et al. (1989) *Nucleic Acids Res.* 17:7891-7903; and Joshi et al. (1987) *Nucleic Acids Res.* 15:9627-9639.

Additional regulatory signals include, but are not limited to, transcriptional initiation start sites, operators, activators, enhancers, other regulatory elements, ribosomal binding sites, an initiation codon, termination signals, and the like. See, for example, U.S. Pat. Nos. 5,039,523 and 4,853,331; EPO 0480762A2; Sambrook et al. (1992) Molecular Cloning: A Laboratory Manual, ed. Maniatis et al. (Cold Spring Harbor Laboratory Press, Cold Spring Harbor, N.Y.) (hereinafter "Sambrook 11"); Davis et al., eds. (1980) Advanced Bacterial Genetics (Cold Spring Harbor Laboratory Press), Cold Spring Harbor, N.Y., and the references cited therein.

In preparing the expression cassette, the various DNA fragments may be manipulated, so as to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites, or the like. For this purpose, in vitro mutagenesis, primer repair, restriction, annealing, resubstitutions, e.g., transitions and transversions, may be involved.

A number of promoters can be used in the practice of the invention. The promoters can be selected based on the desired outcome. The nucleic acids can be combined with constitutive, inducible, tissue-preferred, or other promoters for expression in the organism of interest. See, for example, promoters set forth in WO 99/43838 and in U.S. Pat. Nos. 8,575,425; 7,790,846; 8,147,856; 8,586832; 7,772,369; 7,534,939; 6,072,050; 5,659,026; 5,608,149; 5,608,144; 5,604,121; 5,569,597; 5,466,785; 5,399,680; 5,268,463; 5,608,142; and 6,177,611; herein incorporated by reference.

For expression in plants, constitutive promoters also include CaMV 35S promoter (Odell et al. (1985) *Nature* 313:810-812); rice actin (McElroy et al. (1990) *Plant Cell* 2:163-171); ubiquitin (Christensen et al. (1989) *Plant Mol. Biol.* 12:619-632 and Christensen et al. (1992) *Plant Mol. Biol.* 18:675-689); pEMU (Last et al. (1991) *Theor. Appl. Genet.* 81:581-588); MAS (Velten et al. (1984) *EMBO J.* 3:2723-2730). Inducible promoters include those that drive expression of pathogenesis-related proteins (PR proteins), which are induced following infection by a pathogen. See, for example, Redolfi et al. (1983) *Neth. J. Plant Pathol.* 89:245-254; Uknes et al. (1992) *Plant Cell* 4:645-656; and Van Loon (1985) *Plant Mol. Virol.* 4:111-116; and WO 99/43819, each herein incorporated by reference. Promoters that are expressed locally at or near the site of pathogen infection may also be used (Marineau et al. (1987) *Plant Mol. Biol.* 9:335-342; Matton et al. (1989) *Molecular Plant-Microbe Interactions* 2:325-331; Somsisch et al. (1986) *Proc. Natl. Acad. Sci. USA* 83:2427-2430; Somsisch et al. (1988) *Mol. Gen. Genet.* 2:93-98; and Yang (1996) *Proc. Natl. Acad. Sci. USA* 93:14972-14977; Chen et al. (1996) *Plant J.* 10:955-966; Zhang et al. (1994) *Proc. Natl. Acad. Sci. USA* 91:2507-2511; Warner et al. (1993) *Plant J.* 3:191-201; Siebertz et al. (1989) *Plant Cell* 1:961-968; Cordero et al. (1992) *Physiol. Mol. Plant Path.* 41:189-200; U.S. Pat. No. 5,750,386 (nematode-inducible); and the references cited therein).

Wound-inducible promoters may be used in the constructions of the invention. Such wound-inducible promoters include pin II promoter (Ryan (1990) *Ann. Rev. Phytopath.* 28:425-449; Duan et al. (1996) *Nature Biotechnology* 14:494-498); wun1 and wun2 (U.S. Pat. No. 5,428,148); win1 and win2 (Stanford et al. (1989) *Mol. Gen. Genet.* 215:200-208); systemin (McGurl et al. (1992) *Science* 225:1570-1573); WIP1 (Rohmeier et al. (1993) *Plant Mol. Biol.* 22:783-792; Eckelkamp et al. (1993) *FEBS Letters* 323:73-76); MPI gene (Corderok et al. (1994) *Plant J.* 6(2):141-150); and the like, herein incorporated by reference.

Tissue-preferred promoters for use in the invention include those set forth in Yamamoto et al. (1997) *Plant J.* 12(2):255-265; Kawamata et al. (1997) *Plant Cell Physiol.* 38(7):792-803; Hansen et al. (1997) *Mol. Gen Genet.* 254(3):337-343; Russell et al. (1997) *Transgenic Res.* 6(2):157-168; Rinehart et al. (1996) *Plant Physiol.* 112(3): 1331-1341; Van Camp et al. (1996) *Plant Physiol.* 112(2):525-535; Canevascini et al. (1996) *Plant Physiol.* 112(2):513-524; Yamamoto et al. (1994) *Plant Cell Physiol.* 35(5):773-778; Lam (1994) *Results Probl. Cell Differ.* 20:181-196; Orozco et al. (1993) *Plant Mol Biol.* 23(6):1129-1138; Matsuoka et al. (1993) *Proc Natl. Acad. Sci. USA* 90(20):9586-9590; and Guevara-Garcia et al. (1993) *Plant J.* 4(3):495-505.

Leaf-preferred promoters include those set forth in Yamamoto et al. (1997) *Plant J.* 12(2):255-265; Kwon et al. (1994) *Plant Physiol.* 105:357-67; Yamamoto et al. (1994) *Plant Cell Physiol.* 35(5):773-778; Gotor et al. (1993) *Plant J.* 3:509-18; Orozco et al. (1993) *Plant Mol. Biol.* 23(6):1129-1138; and Matsuoka et al. (1993) *Proc. Natl. Acad. Sci. USA* 90(20):9586-9590.

Root-preferred promoters are known and include those in Hire et al. (1992) *Plant Mol. Biol.* 20(2):207-218 (soybean root-specific glutamine synthetase gene); Keller and Baumgartner (1991) *Plant Cell* 3(10):1051-1061 (root-specific control element); Sanger et al. (1990) *Plant Mol. Biol.* 14(3):433-443 (mannopine synthase (MAS) gene of *Agrobacterium tumefaciens*); and Miao et al. (1991) *Plant Cell* 3(1):11-22 (cytosolic glutamine synthetase (GS)); Bogusz et al. (1990) *Plant Cell* 2(7):633-641; Leach and Aoyagi (1991) *Plant Science* (Limerick) 79(1):69-76 (rolC and rolD); Teeri et al. (1989) *EMBO J.* 8(2):343-350; Kuster et al. (1995) *Plant Mol. Biol.* 29(4):759-772 (the VfENOD-GRP3 gene promoter); and Capana et al. (1994) *Plant Mol. Biol.* 25(4):681-691 (rolB promoter). See also U.S. Pat. Nos. 5,837,876; 5,750,386; 5,633,363; 5,459,252; 5,401,836; 5,110,732; and 5,023,179.

"Seed-preferred" promoters include both "seed-specific" promoters (those promoters active during seed development such as promoters of seed storage proteins) as well as "seed-germinating" promoters (those promoters active during seed germination). See Thompson et al. (1989) *BioEssays* 10:108. Seed-preferred promoters include, but are not limited to, Cim1 (cytokinin-induced message); cZ19B1 (maize 19 kDa zein); milps (myo-inositol-1-phosphate synthase) (see WO 00/11177 and U.S. Pat. No. 6,225,529). Gamma-zein is an endosperm-specific promoter. Globulin 1 (Glb-1) is a representative embryo-specific promoter. For dicots, seed-specific promoters include, but are not limited to, bean β-phaseolin, napin, β-conglycinin, soybean lectin, cruciferin, and the like. For monocots, seed-specific promoters include, but are not limited to, maize 15 kDa zein, 22 kDa zein, 27 kDa zein, gamma-zein, waxy, shrunken 1, shrunken 2, Globulin 1, etc. See also WO 00/12733, where seed-preferred promoters from end1 and end2 genes are disclosed.

For expression in a bacterial host, promoters that function in bacteria are well-known in the art. Such promoters include any of the known crystal protein gene promoters, including the promoters of any of the pesticidal proteins of the invention, and promoters specific for *B. thuringiensis* sigma factors. Alternatively, mutagenized or recombinant crystal protein-encoding gene promoters may be recombinantly engineered and used to promote expression of the novel gene segments disclosed herein.

The expression cassette can also comprise a selectable marker gene for the selection of transformed cells. Selectable marker genes are utilized for the selection of transformed cells or tissues. Marker genes include genes encoding antibiotic resistance, such as those encoding neomycin phosphotransferase II (NEO) and hygromycin phosphotransferase (HPT), as well as genes conferring resistance to herbicidal compounds, such as glufosinate ammonium, bromoxynil, imidazolinones, and 2,4-dichlorophenoxyacetate (2,4-D). Additional selectable markers are known and any can be used. See, for example, U.S. Provisional application 62/094,697, filed on Dec. 19, 2014, herein incorporated by reference in its entirety, which discloses glufosinate resistance sequences that can be employed as selectable markers.

IV. Methods, Host Cells and Plant Cells

As indicated, DNA constructs comprising nucleotide sequences encoding the pesticidal proteins or active variants or fragment thereof can be used to transform plants of interest or other organisms of interest. Methods for transformation involve introducing a nucleotide construct into a plant. By "introducing" is intended to introduce the nucleotide construct to the plant or other host cell in such a manner that the construct gains access to the interior of a cell of the plant or host cell. The methods of the invention do not require a particular method for introducing a nucleotide construct to a plant or host cell, only that the nucleotide construct gains access to the interior of at least one cell of the plant or the host organism. Methods for introducing nucleotide constructs into plants and other host cells are known in the art including, but not limited to, stable transformation methods, transient transformation methods, and virus-mediated methods.

The methods result in a transformed organisms, such as a plant, including whole plants, as well as plant organs (e.g., leaves, stems, roots, etc.), seeds, plant cells, propagules, embryos and progeny of the same. Plant cells can be differentiated or undifferentiated (e.g. callus, suspension culture cells, protoplasts, leaf cells, root cells, phloem cells, pollen).

"Transgenic plants" or "transformed plants" or "stably transformed" plants or cells or tissues refers to plants that have incorporated or integrated a polynucleotide encoding at least one pesticidal polypeptide of the invention. It is recognized that other exogenous or endogenous nucleic acid sequences or DNA fragments may also be incorporated into the plant cell. *Agrobacterium*- and biolistic-mediated transformation remain the two predominantly employed approaches. However, transformation may be performed by infection, transfection, microinjection, electroporation, microprojection, biolistics or particle bombardment, electroporation, silica/carbon fibers, ultrasound mediated, PEG mediated, calcium phosphate co-precipitation, polycation DMSO technique, DEAE dextran procedure, Agro and viral mediated (Caulimoriviruses, Geminiviruses, RNA plant viruses), liposome mediated and the like.

Transformation protocols as well as protocols for introducing polypeptides or polynucleotide sequences into plants may vary depending on the type of plant or plant cell, i.e., monocot or dicot, targeted for transformation. Methods for transformation are known in the art and include those set forth in U.S. Pat. Nos. 8,575,425; 7,692,068; 8,802,934; and 7,541,517; each of which is herein incorporated by reference. See, also, Rakoczy-Trojanowska, M. (2002) *Cell Mol Biol Lett.* 7:849-858; Jones et al. (2005) *Plant Methods* 1:5; Rivera et al. (2012) *Physics of Life Reviews* 9:308-345; Bartlett et al. (2008) *Plant Methods* 4:1-12; Bates, G. W. (1999) *Methods in Molecular Biology* 111:359-366; Binns and Thomashow (1988) *Annual Reviews in Microbiology* 42:575-606; Christou, P. (1992) *The Plant Journal* 2:275-281; Christou, P. (1995) *Euphytica* 85:13-27; Tzfira et al. (2004) *TRENDS in Genetics* 20:375-383; Yao et al. (2006) *Journal of Experimental Botany* 57:3737-3746; Zupan and Zambryski (1995) *Plant Physiology* 107:1041-1047; and Jones et al. (2005) *Plant Methods* 1:5.

Transformation may result in stable or transient incorporation of the nucleic acid into the cell. "Stable transformation" is intended to mean that the nucleotide construct introduced into a host cell integrates into the genome of the host cell and is capable of being inherited by the progeny thereof. "Transient transformation" is intended to mean that a polynucleotide is introduced into the host cell and does not integrate into the genome of the host cell.

Methods for transformation of chloroplasts are known in the art. See, for example, Svab et al. (1990) Proc. Natl. Acad. Sci. USA 87:8526-8530; Svab and Maliga (1993) Proc. Natl. Acad. Sci. USA 90:913-917; Svab and Maliga (1993) EMBO J. 12:601-606. The method relies on particle gun delivery of DNA containing a selectable marker and targeting of the DNA to the plastid genome through homologous recombination. Additionally, plastid transformation can be accomplished by transactivation of a silent plastid-borne transgene by tissue-preferred expression of a nuclear-encoded and plastid-directed RNA polymerase. Such a system has been reported in McBride et al. (1994) Proc. Natl. Acad. Sci. USA 91:7301-7305.

The cells that have been transformed may be grown into plants in accordance with conventional ways. See, for example, McCormick et al. (1986) Plant Cell Reports 5:81-84. These plants may then be grown, and either pollinated with the same transformed strain or different strains, and the resulting hybrid having constitutive expression of the desired phenotypic characteristic identified. Two or more generations may be grown to ensure that expression of the desired phenotypic characteristic is stably maintained and inherited and then seeds harvested to ensure expression of the desired phenotypic characteristic has been achieved. In this manner, the present invention provides transformed seed (also referred to as "transgenic seed") having a nucleotide construct of the invention, for example, an expression cassette of the invention, stably incorporated into their genome.

In specific embodiments, the sequences provide herein can be targeted to a specific site within the genome of the host cell or plant cell. Such methods include, but are not limited to, meganucleases designed against the plant genomic sequence of interest (D'Halluin et al. 2013 *Plant Biotechnol J*); CRISPR-Cas9, TALENs, and other technologies for precise editing of genomes (Feng, et al. Cell Research 23:1229-1232, 2013, Podevin, et al. *Trends Biotechnology, online publication,* 2013, Wei et al., *J Gen Genomics,* 2013, Zhang et at (2013) WO 2013/026740); Cre-lox site-specific recombination (Dale et al. (1995) *Plant J* 7:649-659; Lyznik, et al. (2007) *Transgenic Plant J* 1:1-9; FLP-FRT recombination (Li et al. (2009) *Plant Physiol* 151:1087-1095); Bxb1-mediated integration (Yau et al. *Plant J* (2011) 701:147-166); zinc-finger mediated integration (Wright et al. (2005) *Plant J* 44:693-705); Cai et al. (2009) *Plant Mol Biol* 69:699-709); and homologous recombination (Lieberman-Lazarovich and Levy (2011) *Methods Mol Biol* 701: 51-65); Puchta (2002) *Plant Mol Biol* 48:173-182).

The sequence provided herein may be used for transformation of any plant species, including, but not limited to, monocots and dicots. Examples of plants of interest include, but are not limited to, corn (maize), sorghum, wheat, sunflower, tomato, crucifers, peppers, potato, cotton, rice, soybean, sugarbeet, sugarcane, tobacco, barley, and oilseed rape, *Brassica* sp., alfalfa, rye, millet, safflower, peanuts, sweet potato, cassaya, coffee, coconut, pineapple, citrus trees, cocoa, tea, banana, avocado, fig, guava, mango, olive, papaya, cashew, macadamia, almond, oats, vegetables, ornamentals, and conifers.

Vegetables include, but are not limited to, tomatoes, lettuce, green beans, lima beans, peas, and members of the genus *Curcumis* such as cucumber, cantaloupe, and musk melon. Ornamentals include, but are not limited to, azalea, hydrangea, hibiscus, roses, tulips, daffodils, petunias, carnation, poinsettia, and chrysanthemum. Preferably, plants of the present invention are crop plants (for example, maize, sorghum, wheat, sunflower, tomato, crucifers, peppers, potato, cotton, rice, soybean, sugarbeet, sugarcane, tobacco, barley, oilseed rape, etc.).

As used herein, the term plant includes plant cells, plant protoplasts, plant cell tissue cultures from which plants can be regenerated, plant calli, plant clumps, and plant cells that are intact in plants or parts of plants such as embryos, pollen, ovules, seeds, leaves, flowers, branches, fruit, kernels, ears, cobs, husks, stalks, roots, root tips, anthers, and the like. Grain is intended to mean the mature seed produced by commercial growers for purposes other than growing or reproducing the species. Progeny, variants, and mutants of the regenerated plants are also included within the scope of the invention, provided that these parts comprise the introduced polynucleotides. Further provided is a processed plant product or byproduct that retains the sequences disclosed herein, including for example, soymeal.

In another embodiment, the genes encoding the pesticidal proteins can be used to transform insect pathogenic organisms. Such organisms include baculoviruses, fungi, protozoa, bacteria, and nematodes. Microorganism hosts that are known to occupy the "phytosphere" (phylloplane, phyllosphere, rhizosphere, and/or rhizoplana) of one or more crops of interest may be selected. These microorganisms are selected so as to be capable of successfully competing in the particular environment with the wild-type microorganisms, provide for stable maintenance and expression of the gene expressing the pesticidal protein, and desirably, provide for improved protection of the pesticide from environmental degradation and inactivation.

Such microorganisms include archaea, bacteria, algae, and fungi. Of particular interest are microorganisms such as bacteria, e.g., *Bacillus, Pseudomonas, Erwinia, Serratia, Klebsiella, Xanthomonas, Streptomyces, Rhizobium, Rhodopseudomonas, Methylius, Agrobacterium, Acetobacter, Lactobacillus, Arthrobacter, Azotobacter, Leuconostoc*, and *Alcaligenes*. Fungi include yeast, e.g., *Saccharomyces, Cryptococcus, Kluyveromyces, Sporobolomyces, Rhodotorula*, and *Aureobasidium*. Of particular interest are such phytosphere bacterial species as *Pseudomonas syringae, Pseudomonas aeruginosa, Pseudomonas fluorescens, Serratia marcescens, Acetobacter xylinum, Agrobacteria, Rhodopseudomonas spheroides, Xanthomonas campestris, Rhizobium melioti, Alcaligenes entrophus, Clavibacter xyli* and *Azotobacter vinlandir* and phytosphere yeast species such as *Rhodotorula rubra, R. glutinis, R. marina, R. aurantiaca, Cryptococcus albidus, C. diffluens, C. laurentii, Saccharomyces rosei, S. pretoriensis, S. cerevisiae, Sporobolomyces rosues, S. odorus, Kluyveromyces veronae, Aureobasidium pollulans, Bacillus thuringiensis, Escherichia coli, Bacillus subtilis*, and the like.

Illustrative prokaryotes, both Gram-negative and gram-positive, include Enterobacteriaceae, such as *Escherichia, Erwinia, Shigella, Salmonella*, and *Proteus*; Bacillaceae; Rhizobiceae, such as *Rhizobium*; Spirillaceae, such as photobacterium, *Zymomonas, Serratia, Aeromonas, Vibrio, Desulfovibrio, Spirillum*; Lactobacillaceae; Pseudomonadaceae, such as *Pseudomonas* and *Acetobacter*; Azotobacteraceae and Nitrobacteraceae. Fungi include Phycomycetes and Ascomycetes, e.g., yeast, such as *Saccharomyces* and *Schizosaccharomyces*; and Basidiomycetes yeast, such as *Rhodotorula, Aureobasidium, Sporobolomyces*, and the like.

Genes encoding pesticidal proteins can be introduced by means of electrotransformation, PEG induced transformation, heat shock, transduction, conjugation, and the like. Specifically, genes encoding the pesticidal proteins can be cloned into a shuttle vector. An exemplary shuttle vector is pHT3101 (Lerecius et al. (1989) *FEMS Microbiol. Letts.* 60: 211-218). The shuttle vector pHT3101 containing the coding sequence for the particular pesticidal protein gene can, for example, be transformed into the root-colonizing *Bacillus* by means of electroporation (Lerecius et al. (1989) *FEMS Microbiol. Letts.* 60: 211-218).

Expression systems can be designed so that pesticidal proteins are secreted outside the cytoplasm of gram-negative bacteria by fusing an appropriate signal peptide to the amino-terminal end of the pesticidal protein. Signal peptides recognized by *E. coli* include the OmpA protein (Ghrayeb et al. (1984) *EMBO J*, 3: 2437-2442).

Pesticidal proteins and active variants thereof can be fermented in a bacterial host and the resulting bacteria processed and used as a microbial spray in the same manner that *Bacillus thuringiensis* strains have been used as insecticidal sprays. In the case of a pesticidal protein(s) that is secreted from *Bacillus*, the secretion signal is removed or mutated using procedures known in the art. Such mutations and/or deletions prevent secretion of the pesticidal protein(s) into the growth medium during the fermentation process. The pesticidal proteins are retained within the cell, and the cells are then processed to yield the encapsulated pesticidal proteins.

Alternatively, the pesticidal proteins are produced by introducing heterologous genes into a cellular host. Expression of the heterologous gene results, directly or indirectly, in the intracellular production and maintenance of the pesticide. These cells are then treated under conditions that prolong the activity of the toxin produced in the cell when the cell is applied to the environment of target pest(s). The resulting product retains the toxicity of the toxin. These naturally encapsulated pesticidal proteins may then be formulated in accordance with conventional techniques for application to the environment hosting a target pest, e.g., soil, water, and foliage of plants. See, for example U.S. Pat. No. 6,468,523 and U.S. Publication No. 20050138685, and the references cited therein. In the present invention, a transformed microorganism (which includes whole organisms, cells, spore(s), pesticidal protein(s), pesticidal component(s), pest-impacting component(s), mutant(s), living or dead cells and cell components, including mixtures of living and dead cells and cell components, and including broken cells and cell components) or an isolated pesticidal protein can be formulated with an acceptable carrier into a pesticidal or agricultural composition(s) that is, for example, a suspension, a solution, an emulsion, a dusting powder, a dispersible granule, a wettable powder, and an emulsifiable concentrate, an aerosol, an impregnated granule, an adjuvant, a coatable paste, and also encapsulations in, for example, polymer substances.

Agricultural compositions may comprise a polypeptide, a recombinogenic polypeptide or a variant or fragment thereof, as disclosed herein. The agricultural composition disclosed herein may be applied to the environment of a plant or an area of cultivation, or applied to the plant, plant part, plant cell, or seed.

Such compositions disclosed above may be obtained by the addition of a surface-active agent, an inert carrier, a preservative, a humectant, a feeding stimulant, an attractant, an encapsulating agent, a binder, an emulsifier, a dye, a UV protectant, a buffer, a flow agent or fertilizers, micronutrient donors, or other preparations that influence plant growth. One or more agrochemicals including, but not limited to, herbicides, insecticides, fungicides, bactericides, nematicides, molluscicides, acaracides, plant growth regulators, harvest aids, and fertilizers, can be combined with carriers, surfactants or adjuvants customarily employed in the art of formulation or other components to facilitate product handling and application for particular target pests. Suitable carriers and adjuvants can be solid or liquid and correspond to the substances ordinarily employed in formulation technology, e.g., natural or regenerated mineral substances, solvents, dispersants, wetting agents, tackifiers, binders, or fertilizers. The active ingredients of the present invention are normally applied in the form of compositions and can be applied to the crop area, plant, or seed to be treated. For example, the compositions of the present invention may be applied to grain in preparation for or during storage in a grain bin or silo, etc. The compositions of the present invention may be applied simultaneously or in succession with other compounds. Methods of applying an active ingredient of the present invention or an agrochemical composition of the present invention that contains at least one of the pesticidal proteins produced by the bacterial strains of the present invention include, but are not limited to, foliar application, seed coating, and soil application. The number of applications and the rate of application depend on the intensity of infestation by the corresponding pest.

Suitable surface-active agents include, but are not limited to, anionic compounds such as a carboxylate of, for example, a metal; a carboxylate of a long chain fatty acid; an N-acylsarcosinate; mono or di-esters of phosphoric acid with fatty alcohol ethoxylates or salts of such esters; fatty alcohol sulfates such as sodium dodecyl sulfate, sodium octadecyl sulfate or sodium cetyl sulfate; ethoxylated fatty alcohol sulfates; ethoxylated alkylphenol sulfates; lignin sulfonates; petroleum sulfonates; alkyl aryl sulfonates such as alkyl-benzene sulfonates or lower alkylnaphthalene sulfonates, e.g., butyl-naphthalene sulfonate; salts of sulfonated naphthalene-formaldehyde condensates; salts of sulfonated phenol-formaldehyde condensates; more complex sulfonates such as the amide sulfonates, e.g., the sulfonated condensation product of oleic acid and N-methyl taurine; or the dialkyl sulfosuccinates, e.g., the sodium sulfonate of dioctyl succinate. Non-ionic agents include condensation products of fatty acid esters, fatty alcohols, fatty acid amides or fatty-alkyl- or alkenyl-substituted phenols with ethylene oxide, fatty esters of polyhydric alcohol ethers, e.g., sorbitan fatty acid esters, condensation products of such esters with ethylene oxide, e.g., polyoxyethylene sorbitar fatty acid esters, block copolymers of ethylene oxide and propylene oxide, acetylenic glycols such as 2,4,7,9-tetraethyl-5-decyn-4,7-diol, or ethoxylated acetylenic glycols. Examples of a cationic surface-active agent include, for instance, an aliphatic mono-, di-, or polyamine such as an acetate, naphthenate or oleate; or oxygen-containing amine such as an amine oxide of polyoxyethylene alkylamine; an amide-linked amine prepared by the condensation of a carboxylic acid with a di- or polyamine; or a quaternary ammonium salt.

Examples of inert materials include but are not limited to inorganic minerals such as kaolin, phyllosilicates, carbonates, sulfates, phosphates, or botanical materials such as cork, powdered corncobs, peanut hulls, rice hulls, and walnut shells.

The compositions of the present invention can be in a suitable form for direct application or as a concentrate of primary composition that requires dilution with a suitable quantity of water or other diluent before application. The pesticidal concentration will vary depending upon the nature of the particular formulation, specifically, whether it is a concentrate or to be used directly. The composition contains 1 to 98% of a solid or liquid inert carrier, and 0 to 50% or 0.1 to 50% of a surfactant (w/w, v/v, or w/v, as appropriate or desired). These compositions will be administered at the labeled rate for the commercial product, for example, about 0.01 lb-5.0 lb. per acre when in dry form and at about 0.01 pts-10 pts per acre when in liquid form.

In a further embodiment, the compositions, as well as the transformed microorganisms and pesticidal proteins, provided herein can be treated prior to formulation to prolong the pesticidal activity when applied to the environment of a target pest as long as the pretreatment is not deleterious to the pesticidal activity. Such treatment can be by chemical means, physical means, or both, as long as the treatment does not deleteriously affect the properties of the composition(s). Examples of chemical reagents include but are not limited to halogenating agents; aldehydes such as formaldehyde and glutaraldehyde; anti-infectives, such as zephiran chloride; alcohols, such as isopropanol and ethanol; and histological fixatives, such as Bouin's fixative and Helly's fixative (see, for example, Humason (1967) *Animal Tissue Techniques* (W.H. Freeman and Co.).

In one aspect, pests may be killed or reduced in numbers in a given area by application of the pesticidal proteins provided herein to the area. Alternatively, the pesticidal proteins may be prophylactically applied to an environmental area to prevent infestation by a susceptible pest. Preferably the pest ingests, or is contacted with, a pesticidally-effective amount of the polypeptide. By "pesticidally-effective amount" is intended an amount of the pesticide that is able to bring about death to at least one pest, or to noticeably reduce pest growth, feeding, or normal physiological development. This amount will vary depending on such factors as, for example, the specific target pests to be controlled, the specific environment, location, plant, crop, or agricultural site to be treated, the environmental conditions, and the method, rate, concentration, stability, and quantity of application of the pesticidally-effective polypeptide composition. The formulations or compositions may also vary with respect to climatic conditions, environmental considerations, and/or frequency of application and/or severity of pest infestation.

The active ingredients are normally applied in the form of compositions and can be applied to the crop area, plant, or seed to be treated. Methods are therefore provided for providing to a plant, plant cell, seed, plant part or an area of cultivation, an effective amount of the agricultural composition comprising the polypeptide, recombinogenic polypeptide or an active variant or fragment thereof. By "effective amount" is intended an amount of a protein or composition has pesticidal activity that is sufficient to kill or control the pest or result in a noticeable reduction in pest growth, feeding, or normal physiological development. Such decreases in pest numbers, pest growth, pest feeding or pest normal development can comprise any statistically significant decrease, including, for example a decrease of about 5%, 10%, 15%, 20%, 25%, 30%, 35%, 40%, 45%, 50%, 55%, 60%, 65%, 70%, 75%, 85%, 90%, 95% or greater. For example, the compositions may be applied to grain in preparation for or during storage in a grain bin or silo, etc. The compositions may be applied simultaneously or in succession with other compounds. Methods of applying an active ingredient or an agrochemical composition comprising at least one of the polypeptides, recombinogenic polypeptides, or variants or fragments thereof, as disclosed herein include, but are not limited to, foliar application, seed coating, and soil application.

Methods for increasing plant yield are provided. The methods comprise providing a plant or plant cell expressing a polynucleotide encoding the pesticidal polypeptide sequence disclosed herein and growing the plant or a seed thereof in a field infested with (or susceptible to infestation by) a pest against which said polypeptide has pesticidal activity. In some embodiments, the polypeptide has pesticidal activity against a lepidopteran, coleopteran, dipteran, hemipteran, or nematode pest, and said field is infested with a lepidopteran, hemipteran, coleopteran, dipteran, or nematode pest. As defined herein, the "yield" of the plant refers to the quality and/or quantity of biomass produced by the plant. By "biomass" is intended any measured plant product. An increase in biomass production is any improvement in the yield of the measured plant product. Increasing plant yield has several commercial applications. For example, increasing plant leaf biomass may increase the yield of leafy vegetables for human or animal consumption. Additionally, increasing leaf biomass can be used to increase production of plant-derived pharmaceutical or industrial products. An increase in yield can comprise any statistically significant increase including, but not limited to, at least a 1% increase, at least a 3% increase, at least a 5% increase, at least a 10% increase, at least a 20% increase, at least a 30%, at least a 50%, at least a 70%, at least a 100% or a greater increase in yield compared to a plant not expressing the pesticidal sequence. In specific methods, plant yield is increased as a result of improved pest resistance of a plant expressing a pesticidal protein disclosed herein. Expression of the pesticidal protein results in a reduced ability of a pest to infest or feed.

The plants can also be treated with one or more chemical compositions, including one or more herbicide, insecticide, or fungicide, or combination of two or more thereof.

Non-limiting embodiments include:

1. An isolated polypeptide having pesticidal activity, comprising (a) a polypeptide comprising an amino acid sequence selected from the group consisting of sequences set forth in SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, and/or 159; or (b) a polypeptide comprising an amino acid sequence having at least the percent sequence identity set forth in Table 1 to an amino acid sequence selected from the group consisting of sequences set forth in SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, and/or 159.

2. The polypeptide of embodiment 1, wherein said polypeptide comprises the amino acid sequence set forth in SEQ ID NOs. 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, and/or 159.

3. A composition comprising the polypeptide of embodiments 1 or 2.

4. The polypeptide of embodiment 2, further comprising heterologous amino acid sequences.

5. A recombinant nucleic acid molecule that encodes the polypeptide of embodiment 1, wherein said recombinant nucleic acid molecule is not the naturally occurring sequence encoding said polypeptide.

6. The recombinant nucleic acid of embodiment 5, wherein said nucleic acid molecule is a synthetic sequence that has been designed for expression in a plant.

7. The recombinant nucleic acid molecule of embodiment 6, wherein said nucleic acid molecule is operably linked to a promoter capable of directing expression in a plant cell.

8. The recombinant nucleic acid molecule of embodiment 5, wherein said nucleic acid molecule is operably linked to a promoter capable of directing expression in a bacteria.

9. A host cell that contains the recombinant nucleic acid molecule of embodiment 8.

10. The host cell of embodiment 9, wherein said host cell is a bacterial host cell.

11. A DNA construct comprising a promoter that drives expression in a plant cell operably linked to a recombinant nucleic acid molecule comprising (a) a nucleotide sequence that encodes a polypeptide comprising the amino acid sequence of any one of SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, and/or 159; or, (b) a nucleotide sequence that encodes a polypeptide comprising an amino acid sequence having at least the percent sequence identity set forth in Table 1 to an amino acid sequence selected from the group consisting of sequences set forth in SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, and/or 159.

12. The DNA construct of embodiment 11, wherein said nucleotide sequence is a synthetic DNA sequence that has been designed for expression in a plant.

13. A vector comprising the DNA construct of embodiment 11.

14. A host cell that contains the DNA construct of any one of embodiments 11-13.

15. The host cell of embodiment 14, wherein the host cell is a plant cell.

16. A transgenic plant comprising the host cell of embodiment 15.

17. A composition comprising the host cell of embodiment 10.

18. The composition of embodiment 17, wherein said composition is selected from the group consisting of a powder, dust, pellet, granule, spray, emulsion, colloid, and solution.

19. The composition of embodiment 17, wherein said composition comprises from about 1% to about 99% by weight of said polypeptide.

20. A method for controlling a pest population comprising contacting said population with a pesticidal-effective amount of the composition of embodiment 3 or 17.

21. A method for killing a pest population comprising contacting said population with a pesticidal-effective amount of the composition of embodiment 3 or 17.

22. A method for producing a polypeptide with pesticidal activity, comprising culturing the host cell of embodiment 9 under conditions in which the nucleic acid molecule encoding the polypeptide is expressed.

23. A plant having stably incorporated into its genome a DNA construct comprising a nucleotide sequence that encodes a protein having pesticidal activity, wherein said nucleotide sequence comprise (a) a nucleotide sequence that encodes a polypeptide comprising the amino acid sequence of any one of SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, and/or 159; or, (b) a nucleotide sequence that encodes a polypeptide comprising an amino acid sequence having at least the percent sequence identity set forth in Table 1 to an amino acid sequence selected from the group consisting of sequences set forth in SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, and/or 159.

24. A transgenic seed of the plant of embodiment 23.

25. A method for protecting a plant from an insect pest, comprising expressing in a plant or cell thereof a nucleotide sequence that encodes a pesticidal polypeptide, wherein said nucleotide sequence comprising.

(a) a nucleotide sequence that encodes a polypeptide comprising the amino acid sequence of any one of SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, and/or 159; or, (b) a nucleotide sequence that encodes a polypeptide comprising an amino acid sequence having at least the percent sequence identity set forth in Table 1 to an amino acid sequence selected from the group consisting of sequences set forth in SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, and/or 159.

26. The method of embodiment 25, wherein said plant produces a pesticidal polypeptide having pesticidal against a lepidopteran or coleopteran pest or a Hemipteran pest.

27. A method for increasing yield in a plant comprising growing in a field a plant or seed thereof having stably incorporated into its genome a DNA construct comprising a promoter that drives expression in a plant operably linked to a nucleotide sequence that encodes a pesticidal polypeptide, wherein said nucleotide sequence comprises.

(a) a nucleotide sequence that encodes a polypeptide comprising the amino acid sequence of any one of SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, and/or 159; or, (b) a nucleotide sequence that encodes a polypeptide comprising an amino acid sequence having at least the percent sequence identity set forth in Table 1 to an amino acid sequence selected from the group consisting of sequences set forth in SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, and/or 159.

The following examples are offered by way of illustration and not by way of limitation.

EXAMPLES

Example 1

Discovery of Novel Genes by Sequencing and DNA Analysis

Microbiol cultures were grown in liquid culture in standard laboratory media. Cultures were grown to saturation (16 to 24 hours) before DNA preparation. DNA was extracted from bacterial cells by detergent lysis, followed by binding to a silica matrix and washing with an ethanol buffer. Purified DNA was eluted from the silica matrix with a mildly alkaline aqueous buffer.

DNA for sequencing was tested for purity and concentration by spectrophotometry. Sequencing libraries were prepared using the Nextera XT library preparation kit according to the manufacturer's protocol. Sequence data was generated on a HiSeq 2000 according to the Illumina HiSeq 2000 System User Guide protocol.

Sequencing reads were assembled into draft genomes using the CLC Bio Assembly Cell software package. Following assembly, gene calls were made by several methods and resulting gene sequences were interrogated to identify novel homologs of pesticidal genes. Novel genes were identified by BLAST, by domain composition, and by pair-wise alignment versus a target set of pesticidal genes. A summary of such sequences is set forth in Table 1.

Genes identified in the homology search were amplified from bacterial DNA by PCR and cloned into bacterial expression vectors containing fused in-frame purification tags. Cloned genes were expressed in *E. coli* and purified by column chromatography. Purified proteins were assessed in insect diet bioassay studies to identify active proteins.

Insect diet bioassays were performed using a wheat germ and agar artificial diet to which purified protein were applied as a surface treatment. Insect larvae were applied to treated diet and monitored for mortality.

Insect diet bioassays were performed using a sucrose liquid diet contained in a membrane sachet to which purified protein was added. Insect nymphs were allowed to feed on the diet sachet and were monitored for mortality. Insects tested in bioassays included the Brown Stink Bug (BSB), *Euschistus servus*, and the Southern Green Stink Bug (SGSB), *Nezara viridula*. Data is listed in the below in Table 5.

TABLE 5

Bioassay Results

| Gene | Expression Level | Test 1 | Test 2 | Test 3 |
|---|---|---|---|---|
| APG00059 | Very Low (<10 ppm) | +BSB | +SGSB | +SGSB |
| APG00046 | High (>500 ppm) | +BSB | +BSB | |
| APG00002 | Low (50 ppm) | +SGSB | +SGSB | +SGSB |

BSB = Brown Stink Bug,
SGSB = Southern Green Stink Bug

Example 2

Heterologous Expression in *E. coli*

Each open reading frame set forth in Tables 6 and 7 was cloned into an *E. coli* expression vector containing a maltose binding protein (pMBP). The expression vector was transformed into BL21*RIPL. An LB culture supplemented with carbenicillin was inoculated with a single colony and grown overnight at 37° C. using 0.5% of the overnight culture, a fresh culture was inoculated and grown to logarithmic phase at 37° C. The culture was induced using 250 mM IPTG for 18 hours at 16° C. The cells were pelleted and resuspended in 10 mM Tris pH7.4 and 150 mM NaCl supplemented with protease inhibitors. The protein expression was evaluated by SDS-PAGE.

Example 3

Pesticidal Activity Against Coleopteran and Lepidoptera

Protein Expression:

Each sequence set forth in Table 6 was expressed in *E. coli* as described in Example 2. 400 mL of LB was inoculated and grown to an OD600 of 0.6. The culture was induced with 0.25 mM IPTG overnight at 16° C. The cells were spun down and the cell pellet was resuspend in 5 mL of buffer. The resuspension was sonicated for 2 min on ice.

Bioassay:

Fall army worm (FAW), corn ear worm (CEW), European corn borer (ECB) southwestern corn borer (SWCB) and diamond backed moth (DBM) eggs were purchased from a commercial insectary (Benzon Research Inc., Carlisle, Pa.). The FAW, CEW, ECB and BCW eggs were incubated to the point that eclosion would occur within 12 hrs of the assay setup. SWCB and DBM were introduced to the assay as neonate larvae. Assays were carried out in 24-well trays containing multispecies lepidopteran diet (Southland Products Inc., Lake Village, Ark.). Samples of the sonicated lysate were applied to the surface of the diet (diet overlay) and allowed to evaporate and soak into the diet. For CEW, FAW, BCW, ECB and SWCB, a 125 μl of sonicated lysate was added to the diet surface and dried. For DBM, 50 μl of a 1:2 dilution of sonicated lysate was added to the diet surface. The bioassay plates were sealed with a plate sealing film vented with pin holes. The plates were incubated at 26° C. at 65% relative humidity (RH) on a 16:8 day:night cycle in a Percival for 5 days. The assays were assessed for level of mortality, growth inhibition and feeding inhibition.

For the western corn rootworm bioassay, the protein construct/lysate was evaluated in an insect bioassay by dispensing 60 μl volume on the top surface of diet in well/s of 24-well plate (Cellstar, 24-well, Greiner Bio One) and allowed to dry. Each well contained 500 μl diet (Marrone et al., 1985). Fifteen to twenty neonate larvae were introduced in each well using a fine tip paint brush and the plate was covered with membrane (Viewseal, Greiner Bio One). The bioassay was stored at ambient temperature and scored for mortality, and/or growth/feeding inhibition at day 4. FIG. 7 provides the assay scoring guidelines for the corn root worm bioassay.

For Colorado Potato Beetle (CPB) a cork bore size No. 8 leaf disk was excised from potato leaf and was dipped in the protein construct/lysate until thoroughly wet and placed on top of filter disk (Millipore, glass fiber filter, 13 mm). 60 μl dH₂O was added to each filter disk and placed in each well of 24-well plate (Cellstar, 24-well, Greiner Bio One). The leaf disk was allowed to dry and five to seven first instar larvae were introduced in each well using a fine tip paint brush. The plate was covered with membrane (Viewseal, Greiner Bio One) and small hole was punctured in each well of the membrane. The construct was evaluated with four replicates, and scored for mortality and leaf damage on day 3.

Table 6 provides a summary of pesticidal activity against coleopteran and lepidoptera of the various sequences. Table code: "-" indicates no activity seen; "NT" indicates not tested; "S" indicates stunt; "SS" indicates slight stunt; "LF" indicates low feeding.

TABLE 6

Summary of Pesticidal Activity against Coleopteran and Lepidoptera.

| AgB Ref. No. | SEQ ID NO | # of variants | FAW | CEW | BCW | ECB | SWCB | CPB | Px | CRW |
|---|---|---|---|---|---|---|---|---|---|---|
| APG00010 | 9 | 1 | NT | — | — | — | — | NT | NT | >80% mortality |
| APG00034 | 15 | 1 | — | — | — | — | — | — | — | >80% mortality |
| APG00076 | 93 | 2 | — | — | — | — | — | — | — | 50-80% mortality |
| APG00039 | 17 | 2 | — | SS | — | — | — | — | — | — |
| APG00008 | 7 | 1 | SS | — | — | SS | — | — | — | >80% mortality |
| APG00052 | 25 | 2 | S, LF | — | — | — | SS | — | — | 50-80% mortality |
| APG00065 | 32 | 1 | NT | SS | — | — | NT | — | — | NT |
| APG00124 | 71 | 2 | NT | S | — | — | NT | NT | NT | — |
| APG00130 | 94 | 1 | — | — | — | — | — | NT | NT | >80% mortality |

Example 4

Pesticidal Activity Against Hemipteran

Protein Expression:

Each of the sequences set forth in Table 7 was expressed in E. coli as described in Example 2. 400 mL of LB was inoculated and grown to an OD600 of 0.6. The culture was induced with 0.25 mM IPTG overnight at 16° C. The cells were spun down and the cell pellet was re-suspend in 5 mL of buffer. The resuspension was sonicated for 2 min on ice.

Second instar SGSB were obtained from a commercial insectary (Benzon Research Inc., Carlisle, Pa.). A 50% v/v ratio of sonicated lysate sample to 20% sucrose was employed in the bioassay. Stretched parafilm was used as a feeding membrane to expose the SGSB to the diet/sample mixture. The plates were incubated at 25° C.:21° C., 16:8 day:night cycle at 65% RH for 5 days.

Mortality was scored for each sample. The results are set forth in Table 7. A dashed line indicates no mortality was detected. The protein (APG00034) showed 25% mortality against southern green stinkbug (1 stinkbug out of 4 died). The negative controls (empty vector expressed binding domain and buffer only) both showed no mortality (0 stinkbugs out of 4).

TABLE 7

Summary of Pesticidal Activity against Hemipteran

| AgB Ref. No. | SEQ ID NO | Tested against SGSB |
|---|---|---|
| APG00034 | 15 | 25% mortality |
| APG00010 | 9 | — |
| APG00076 | 93 | — |
| APG00039 | 17 | — |
| APG00008 | 7 | — |
| APG00052 | 25 | — |
| APG00065 | 32 | — |
| APG00124 | 71 | — |
| APG00130 | 94 | — |

Example 5

Transformation of Soybean

DNA constructs comprising each of SEQ ID NOs: 1-159 or active variants or fragments thereof operably linked to a promoter active in a plant are cloned into transformation vectors and introduced into Agrobacterium as described in U.S. Provisional Application No. 62/094,782, filed Dec. 19, 2015, herein incorporated by reference in its entirety.

Four days prior to inoculation, several loops of Agrobacterium are streaked to a fresh plate of YEP* medium supplemented with the appropriate antibiotics** (spectinomycin, chloramphenicol and kanamycin). Bacteria are grown for two days in the dark at 28° C. After two days, several loops of bacteria are transferred to 3 ml of YEP liquid medium with antibiotics in a 125 ml Erlenmeyer flask. Flasks are placed on a rotary shaker at 250 RPM at 28° C. overnight. One day before inoculation, 2-3 ml of the overnight culture were transferred to 125 ml of YEP with antibiotics in a 500 ml Erlenmeyer flask. Flasks are placed on a rotary shaker at 250 RPM at 28° C. overnight.

Prior to inoculation, the OD of the bacterial culture is checked at OD 620. An OD of 0.8-1.0 indicates that the culture is in log phase. The culture is centrifuged at 4000 RPM for 10 minutes in Oakridge tubes. The supernatant is discarded and the pellet is re-suspended in a volume of Soybean Infection Medium (SI) to achieve the desired OD. The cultures are held with periodic mixing until needed for inoculation.

Two or three days prior to inoculation, soybean seeds are surface sterilized using chlorine gas. In a fume hood, a petri dish with seeds is place in a bell jar with the lid off. 1.75 ml of 12 N HCl is slowly added to 100 ml of bleach in a 250 ml Erlenmeyer flask inside the bell jar. The lid is immediately placed on top of the bell jar. Seeds are allowed to sterilize for 14-16 hours (overnight). The top is removed from the bell jar and the lid of the petri dish is replaced. The petri dish with the surface sterilized is then opened in a laminar flow for around 30 minutes to disperse any remaining chlorine gas.

Seeds are imbibed with either sterile DI water or soybean infection medium (SI) for 1-2 days. Twenty to 30 seeds are covered with liquid in a 100×25 mm petri dish and incubated in the dark at 24° C. After imbibition, non-germinating seeds are discarded.

Cotyledonary explants are processed on a sterile paper plate with sterile filter paper dampened using SI medium employing the methods of U.S. Pat. No. 7,473,822, herein incorporated by reference.

Typically, 16-20 cotyledons are inoculated per treatment. The SI medium used for holding the explants is discarded and replaced with 25 ml of *Agrobacterium* culture (OD 620=0.8-20). After all explants are submerged, the inoculation is carried out for 30 minutes with periodic swirling of the dish. After 30 minutes, the *Agrobacterium* culture is removed.

Co-cultivation plates is prepared by overlaying one piece of sterile paper onto Soybean Co-cultivation Medium (SCC). Without blotting, the inoculated cotyledons is cultured adaxial side down on the filter paper. Around 20 explants can be cultured on each plate. The plates are sealed with Parafilm and cultured at 24° C. and around 120 µmoles $m^{-2}s^{-1}$ (in a Percival incubator) for 4-5 days.

After co-cultivation, the cotyledons are washed 3 times in 25 ml of Soybean Wash Medium with 200 mg/l of cefotaxime and timentin. The cotyledons are blotted on sterile filter paper and then transferred to Soybean Shoot Induction Medium (SSI). The nodal end of the explant is depressed slightly into the medium with distal end kept above the surface at about 45 deg. No more than 10 explants are cultured on each plate. The plates are wrapped with Micropore tape and cultured in the Percival at 24° C. and around 120 µmoles $m^{-2}s^{-1}$.

The explants are transferred to fresh SSI medium after 14 days. Emerging shoots from the shoot apex and cotyledonary node are discarded. Shoot induction is continued for another 14 days under the same conditions.

After 4 weeks of shoot induction, the cotyledon is separated from the nodal end and a parallel cut is made underneath the area of shoot induction (shoot pad). The area of the parallel cut is placed on Soybean Shoot Elongation Medium (SSE) and the explants cultured in the Percival at 24° C. and around 120 µmoles $m^{-2}s^{-1}$. This step is repeated every two weeks for up to 8 weeks as long as shoots continue to elongate.

When shoots reach a length of 2-3 cm, they are transferred to Soybean Rooting Medium (SR) in a Plantcon vessel and incubated under the same conditions for 2 weeks or until roots reach a length of around 3-4 cm. After this, plants are transferred to soil.

Note, all media mentioned for soybean transformation are found in Paz et al. (2010) *Agrobacterium*-mediated transformation of soybean and recovery of transgenic soybean plants; Plant Transformation Facility of Iowa State University, which is herein incorporated by reference in its entirety. (See, agron-www.agron.iastate.edu/ptf/protocol/Soybean.pdf.)

Example 6

Transformation of Maize

Maize ears are best collected 8-12 days after pollination. Embryos are isolated from the ears, and those embryos 0.8-1.5 mm in size are preferred for use in transformation. Embryos are plated scutellum side-up on a suitable incubation media, such as DN62A5S media (3.98 g/L N6 Salts; 1 mL/L (of 1000× Stock) N6 Vitamins; 800 mg/L L-Asparagine; 100 mg/L Myo-inositol; 1.4 g/L L-Proline; 100 mg/L Casamino acids; 50 g/L sucrose; 1 mL/L (of 1 mg/mL Stock) 2,4-D). However, media and salts other than DN62A5S are suitable and are known in the art. Embryos are incubated overnight at 25° C. in the dark. However, it is not necessary per se to incubate the embryos overnight.

The resulting explants are transferred to mesh squares (30-40 per plate), transferred onto osmotic media for about 30-45 minutes, and then transferred to a beaming plate (see, for example, PCT Publication No. WO/0138514 and U.S. Pat. No. 5,240,842). DNA constructs designed to express the GRG proteins of the present invention in plant cells are accelerated into plant tissue using an aerosol beam accelerator, using conditions essentially as described in PCT Publication No. WO/0138514. After beaming, embryos are incubated for about 30 min on osmotic media, and placed onto incubation media overnight at 25° C. in the dark. To avoid unduly damaging beamed explants, they are incubated for at least 24 hours prior to transfer to recovery media. Embryos are then spread onto recovery period media, for about 5 days, 25° C. in the dark, and then transferred to a selection media. Explants are incubated in selection media for up to eight weeks, depending on the nature and characteristics of the particular selection utilized. After the selection period, the resulting callus is transferred to embryo maturation media, until the formation of mature somatic embryos is observed. The resulting mature somatic embryos are then placed under low light, and the process of regeneration is initiated by methods known in the art. The resulting shoots are allowed to root on rooting media, and the resulting plants are transferred to nursery pots and propagated as transgenic plants.

Example 7

Pesticidal Activity Against Nematodes

*Heterodera glycine*'s (Soybean Cyst Nematode) In Vitro Assay

Soybean Cyst Nematodes are dispensed into a 96 well assay plate with a total volume of 100 uls and 100 J2 per well. The protein of interest as set forth in any one of SEQ ID NOs: 1-159 is dispensed into the wells and held at room temperature for assessment. Finally, the 96 well plate containing the SCN J2 is analyzed for motility. Data is reported as % inhibition as compared to the controls. Hits are defined as greater or equal to 70% inhibition.

*Heterodera glycine*'s (Soybean Cyst Nematode) on-Plant Assay

Soybean plants expressing one or more of SEQ ID NOs: 1-159 are generated as described elsewhere herein. A 3-week-old soybean cutting is inoculated with 5000 SCN eggs per plant. This infection is held for 70 days and then harvested for counting of SCN cyst that has developed on the plant. Data is reported as % inhibition as compared to the controls. Hits are defined as greater or equal to 90% inhibition.

*Meloidogyne incognita* (Root-Knot Nematode) In Vitro Assay

Root-Knot Nematodes are dispensed into a 96 well assay plate with a total volume of 100 uls and 100 J2 per well. The protein of interest comprising any one of SEQ ID NOs: 1-159 is dispensed into the wells and held at room temperature for assessment. Finally the 96 well plate containing the RKN J2 is analyzed for motility. Data is reported as % inhibition as compared to the controls. Hits are defined as greater or equal to 70% inhibition.

*Meloidogyne incognita* (Root-Knot Nematode) on-Plant Assay

Soybean plants expressing one or more of SEQ ID NOs: 1-159 are generated as described elsewhere herein. A 3-week-old soybean is inoculated with 5000 RKN eggs per plant. This infection is held for 70 days and then harvested for counting of RKN eggs that have developed in the plant. Data is reported as % inhibition as compared to the controls. Hits are defined as greater or equal to 90% inhibition.

Example 8

Additional Assays for Pesticidal Activity

The various polypeptides set forth in SEQ ID NOs: 1-159 can be tested to act as a pesticide upon a pest in a number of ways. One such method is to perform a feeding assay. In such a feeding assay, one exposes the pest to a sample containing either compounds to be tested or control samples. Often this is performed by placing the material to be tested, or a suitable dilution of such material, onto a material that the pest will ingest, such as an artificial diet. The material to be tested may be composed of a liquid, solid, or slurry. The material to be tested may be placed upon the surface and then allowed to dry. Alternatively, the material to be tested may be mixed with a molten artificial diet, and then dispensed into the assay chamber. The assay chamber may be, for example, a cup, a dish, or a well of a microtiter plate.

Assays for sucking pests (for example aphids) may involve separating the test material from the insect by a partition, ideally a portion that can be pierced by the sucking mouth parts of the sucking insect, to allow ingestion of the test material. Often the test material is mixed with a feeding stimulant, such as sucrose, to promote ingestion of the test compound.

Other types of assays can include microinjection of the test material into the mouth, or gut of the pest, as well as development of transgenic plants, followed by test of the ability of the pest to feed upon the transgenic plant. Plant testing may involve isolation of the plant parts normally consumed, for example, small cages attached to a leaf, or isolation of entire plants in cages containing insects.

Other methods and approaches to assay pests are known in the art, and can be found, for example in Robertson and Preisler, eds. (1992) Pesticide bioassays with arthropods, CRC, Boca Raton, Fla. Alternatively, assays are commonly described in the journals Arthropod Management Tests and Journal of Economic Entomology or by discussion with members of the Entomological Society of America (ESA). Any one of SEQ ID NOS: 1-159 can be expressed and employed in an assay as set forth in Examples 3 and 4, herein.

All publications and patent applications mentioned in the specification are indicative of the level of skill of those skilled in the art to which this invention pertains. All publications and patent applications are herein incorporated by reference to the same extent as if each individual publication or patent application was specifically and individually indicated to be incorporated by reference.

Although the foregoing invention has been described in some detail by way of illustration and example for purposes of clarity of understanding, it will be obvious that certain changes and modifications may be practiced within the scope of the appended claims.

SEQUENCE LISTING (167 sequences)

SEQ ID NO: 1 - protein, 885 aa, Unknown
  Bacillus sp. obtained from an environmental sample
MANGTKKHVIKKYLELIKPIYYKQNSLLFSPFILSIPGCDISQHGSIPAMKRNCFTLLLYYRRYVMAQLPELQAQSFIPYNVLANPVTGNSAGTDWGEWLSSLKEAWTEFQKTGSDKFLQSVLSTGYDAAQGGSFNYIAVLQAGVAILGTVLGAEFPGITAIAVPALTFLIKWVWPKLTGGSAGESDTQKMLDLIDKEIQQKLDQALSQQDINNWRAYLTSIFEAATNLSQSIIDAQFTGTERSSDRQPRVPTSSDYEDVYTKLNIADAVLSPSTNNILTGNFDVLAIPYYTIGATVRITAYQSFVKFANQWIDVVYPDQTSNTWLKAHQNLDNAKDKMIAMIQQYTANVLRVFTDPKNMPPLGKDKKSINAYNKFVRGMVISGLDLVAVWPSLYPDDYQVQTDLEKTRVIFSDLIGKDQTISNDVTLINMADGKDGSGAFNQHAAIDLNSIFYYHEELSSMQLGIHDGSRGNTTNCYDYGIIANYPNHSYFYGDLYSPSGDATFSAPLNVLNAQTQYSSGYVDSEFIYNSDPSAYGLGCHILGGCTKGDCYNQSSCSEGFGYSCNTSLPSQKINAFYPFKMNLNRSGTSDKLGLMYSLVPLDLSPNNVFGELDSDTRNVIGKGFPAEKGTLSYGRQPMLVREWVNGANAVKLSDVPLTLQMTNMTSGKYYIRVRYANTSNAEISINQQVYAGNQNVQNGGWSLPSTTASNVATNFPNQLYITGINGNYVLEDITWGVDGQGKPITIPSGDVTVTLSRTNMSQSGDLFIDRVELVPAAPQSDYINYSITSQIPNCNNFDTIIWDGNGAQRSTATVTVSGLPDNNGILISGLSSYGWQPLQDVNGHGNNWVTNGGPFTLSNDHTFTAISICGFQNVSSGKITGKLS

SEQ ID NO: 2 - protein, 777 aa, Artificial sequence
  variant of native sequence
MANGTKKHVIKKYLELIKPIYYKQNSLLFSPFILSIPGCDISQHGSIPAMKRNCFTLLLYYRRYVMAQLPELQAQSFIPYNVLANPVTGNSAGTDWGEWLSSLKEAWTEFQKTGSDKFLQSVLSTGYDAAQGGSFNYIAVLQAGVAILGTVLGAEFPGITAIAVPALTFLIKWVWPKLTGGSAGESDTQKMLDLIDKEIQQKLDQALSQQDINNWRAYLTSIFEAATNLSQSIIDAQFTGTERSSDRQPRVPTSSDYEDVYTKLNIADAVLSPSTNNILTGNFDVLAIPYYTIGATVRITAYQSFVKFANQWIDVVYPDQTSNTWLKAHQNLDNAKDKMIAMIQQYTANVLRVFTDPKNMPPLGKDKKSINAYNKFVRGMVISGLDLVAVWPSLYPDDYQVQTDLEKTRVIFSDLIGKDQTISNDVTLINMADGKDGSGAFNQHAAIDLNSIFYYHEELSSMQLGIHDGSRGNTTNCYDYGIIANYPNHSYFYGDLYSPSGDATFSAPLNVLNAQTQYSSGYVDSEFIYNSDPSAYGLGCHILGGCTKGDCYNQSSCSEGFGYSCNTSLPSQKINAFYPFKMNLNRSGTSDKLGLMYSLVPLDLSPNNVFGELDSDTRNVIGKGFPAEKGTLSYGRQPMLVREWVNGANAVKLSDVPLTLQMTNMTSGKYYIRVRYANTSNAEISINQQVYAGNQNVQNGGWSLPSTTASNVATNFPNQLYITGINGNYVLEDITWGVDGQGKPITIPSGDVTVTLSRTNMSQSGDLFIDRVELVPA

SEQ ID NO: 3 - protein, 527 aa, Unknown
  Bacillus sp. from an environmental sample
MAVNGTQLASTVTTVSNDIVQTRTMVQGLFSADNPTQLAPGVTDYWIDYVHQQVQSLPNALASEKRELNTRVNQAKRLSKSQNVLQSDSMGGAGWKLGRKVFISPGDLQYKGPQLVLPPSSLVYPSYAYQTVPESALKPYTRYYLSVFVLQADSLHIISSRYGNAISHVVNVGYSTSMPTSPDGVLNSPHFFQYPIDVGAVHPDANLGITVGFTVPTNGFAKISQVSLTEARPLTAAEVRRVQNQDEQWFQPYLRQQAEIQTSLQVATNQLNAIYNSTNWSGAIGPNVTYTDLANVTVLEPTPSQPRLSTDLPIQDPDAQQKAAIFQATQRAWMQLQARNIVPNSLFLQGGQNWNVEGTVSFPQENNKPVLTLSDWDATVSQMISLPVHNGYTEYRVRVRAKGKGTISIVPPGDAKRMLFFNSPSFFAIQEFYFYPDTSMSQVNLIIQSEGSEFTVDWVEMQEMKFTEEPLGVNGGNAAHTVGITKPVGHLEASNPPMESQSTNSSSNCKCSQSSSQSNSGCRCSQS

SEQ ID NO: 4 - protein, 660 aa, Unknown
  Bacillus sp. from an environmental sample
MDPNAKYEITNTKYNLSHTGNRYSRFPLDNTQYKKLQNMKYENMSTAYQKNGDYAKLPIITAVDWSTASSALILVAGTLISIGSVGVGAAVTTIGTMLPLFWSDLFGTPGENTWQNLIMQGNAVYPVQDFTPYFLQSLNNEIGRSKAVLELFDDIFNYWQEYDTPRAREEVAQQFRNTNTTIVGSLGVISNAREFDIISLATYASLALLHLTLLRQGVKYADKWGLAREEGAYYKNLLKDRIATYTNYCQSRYRAGLDRLRTGTFYGAWVSFNTYRREYTISVLNIIAMFSTFDPDRYPSNYTTNTQLTEKIHVPTRNSSETFYNGFPDLSNTEAKLVPTLSLFKSLSRLDFYSSYTNGIYFLNGIKNHYTYIDGTNAGSLNIIGDERHITYLDGSILSPLVHQCEYDQILTAVINTPNYGISRLAFTSRNLPPYDVYSADNGIQPVRTAKVLPIQPSSLPPSIPPSLRPYMVPINYQLSDITAINTGPFNPDILYNFSWMVASDNNVIQGGNHITQIPAVKGNILQNGAKVREGPGHTGGPIVEFGPHTPANPPALKIRCQVSPAAANKYLNMRIRYASNSTIATNLDFIIGGEVRNSMAFPGTNADITKIDIPYNNFNTVEFQIINPKNVGFMDVSITKASNINGTFLIDKIEFYVRS

SEQ ID NO: 5 - protein, 659 aa, Artificial sequence
  variant of native sequence
MDPNAKYEITNTKYNLSHTGNRYSRFPLDNTQYKKLQNMKYENMSTAYQKNGDYAKLPIITAVDWSTASSALILVAGTLISIGSVGVGAAVTTIGTMLPLFWSDLFGTPGENTWQNLIMQGNAVYPVQDFTPYFLQSLNNEIGRSKAVLELFDDIFNYWQEYDTPRAREEVAQQFRNTNTTIVGSLGVISNAREFDIISLATYASLALLHLTLLRQGVKYADKWGLAREEGAYYKNLLKDRIATYTNYCQSRYRAGLDRLRTGTFYGAWVSFNTYRREYTISVLNIIAMFSTFDPDRYPSNYTTNTQLTEKIHVPTRNSSETFYNGFPDLSNTEAKLVPTLSLFKSLSRLDFYSSYTNGIYFLNGIKNHYTYIDGTNAGSLNIIGDERHITYLDGSILSPLVHQCEYDQILTAVINTPNYGISRLAFTSRNLPPYDVYSADNGIQPVRTAKVLPIQPSSLPPSIPPSLRPYMVPINYQLSDITAINTGPFNPDILYNFSWMVASDNNVIQGGNHITQIPAVKGNILQNGAKVREGPGHTGGPIVEFGPHTPANPPALKIRCQVSPAAANKYLNMRIRYASNSTIATNLDFIIGGEVRNSMAFPGTNADITKIDIPYNNFNTVEFQIINPKNVGFMDVSITKASNINGTFLIDKIEFYVR

SEQ ID NO: 6 - protein, 632 aa, Unknown
  Unknown organism from environmental sample
LNSKSIIENEVQENQYIDIRNICSINGSAKFDPNTNITTLTEAINSQAGAIAGKTALDMRRDFTLVADIYLGSKSSGADGIAIAFHRGSIGFIGTMGGGLGILGAPNGIGFEIDTYWKASSDETGDSFGHGQMNGPHAGFVSTNRNASYLTALAPMQRIPAPNDKWRVLTINWDARNNKLTASLQEKNNDASTRSATPRYQAWELLNPAFDLNQKYTFVIGSATGAANNKHQIGVTLFEAYFTKPTIVANPVDIEIGTAFDPLNYEPIGLKATDEVDGDITKDITVEFNDVDTSKPGAYRVTYKVVNSYGESDEKTIEVVVYTKPTITAHDVAIKKGLAFDPLNYEPIGLKATDPIDGDITDKITVKFNNVDTSKPGKYHVTYKVINSYEKIDEKTIEITVYTKPTIVAQDVKIKKDTAFDPLNYEPIGLKATDPIDGDITDKITVEFNDVDTSKPGAYSVKYKVVNNYEESDEKTIAVTVPVIDDGWENGDPTGWKFFSGETITLEEDEENALNGKWVFYADKHVAIYKQVELKNNTPYQITVYVKPEDEETVAHHIVKVSFKSDSAGQESEEIINERLIDAEQIQKGYRKLTSIPFTPTTIVPNKKPVIIVENFLPGWIGGVRIIVEPTK

SEQ ID NO: 7 - protein, 632 aa, Artificial sequence
  variant of native sequence
MNSKSIIENEVQENQYIDIRNICSINGSAKFDPNTNITTLTEAINSQAGAIAGKTALDMRRDFTLVADIYLGSKSSGADGIAIAFHRGSIGFIGTMGGGLGILGAPNGIGFEIDTYWKASSDETGDSFGHGQMNGPHAGFVSTNRNASYLTALAPMQRIPAPNDKWRVLTINWDARNNKLTASLQEKNNDASTRSATPRYQAWELLNPAFDLNQKYTFVIGSATGAANNKHQIGVTLFEAYFTKPTIVANPVDIEIGTAFDPLNYEPIGLKATDEVDGDITKDITVEFNDVDTSKPGAYRVTYKVVNSYGESDEKTIEVVVYTKPTITAHDVAIKKGLAFDPLNYEPIGLKATDPIDGDITDKITVKFNNVDTSKPGKYHVTYKVINSYEKIDEKTIEITVYTKPTIVAQDVKIKKDTAFDPLNYEPIGLKATDPIDGDITDKITVEFNDVDTSKPGAYSVKYKVVNNYEESDEKTIAVTVPVIDDGWENGDPTGWKFFSGETITLEEDEENALNGKWVFYADKHVAIYKQVELKNNTPYQITVYVKPEDEETVAHHIVKVSFKSDSAGQESEEIINERLIDAEQIQKGYRKLTSIPFTPTTIVPNKKPVIIVENFLPGWIGGVRIIVEPTK

SEQ ID NO: 8 - protein, 319 aa, Unknown
  Lysinibacillus sp. obtained from an environmental sample
MKNKIILYGVVTSTLLAGGPFSNNASASENQGLTGNNIGVVSSNIKAAEQSQNKNSAYQDIDERVKKMLISAAFDGTEYRYHHIKDTELNGNIIEGSMIENAQILTIGENILENNLGHEVTLFTSGYEHEFKEMTSTTNTSGWTFGYNYNATLSVMMVSASQSFSVDYNMSTSNTTEKSQVRKFTVPPQGFPVPAGKKYKVEYVFEKITISGRNRLNADLYGDATYYYNNLPMSPQLLYSAMNFASDTQGFERVIRDNAEGNDRFGIRATGEGRFSTEFGTRLYAKITDITDSKKPVTIETKKIPVNFETLSVATKIIE

SEQ ID NO: 9 - protein, 293 aa, Artificial sequence
  variant of native sequence
MSENQGLTGNNIGVVSSNIKAAEQSQNKNSAYQDIDERVKKMLISAAFDGTEYRYHHIKDTELNGNIIEGSMIENAQILTIGENILENNLGHEVTLFTSGYEHEFKEMTSTTNTSGWTFGYNYNATLSVMMVSASQSFSVDYNMSTSNTTEKSQVRKFTVPPQGFPVPAGKKYKVEYVFEKITISGRNRLNADLYGDATYYYNNLPMSPQLLYSAMNFASDTQGFERVIRDNAEGNDRFGIRATGEGRFSTEFGTRLYAKITDITDSKKPVTIETKKIPVNFETLSVATKIIE

SEQ ID NO: 10 - protein, 803 aa, Unknown
  Bacillus sp. from an environmental sample
MDKKQKKILSMTLALGVLTGTYIPITSTALAETEKESIKKSSAKTSPQMDSRAWINNPYQGVSMGQFLNAFNGNQWKPLLEQIHNKGDAGSGTIAFLKGMMTTGLSLLPPPGSLLASVWDIFIPGTGVKDDMWLQIEKYVDEKIDSKINDYHKYLMGAQFNGAMEKVKEYQRVLQIYNNSKVSVKVEEPEAPVRDAVRKADSELASYIAVIQTPEKETDSVYQQITAPIFVQAANLHLLVLRDIIQFGEEWGIDKDQLKGYKDKQEKLIENYTDYSIKVYNDGLEKRINEADKIFGPEDGYGNPAKPGPEEAYTNTHRWNYINEYIREYTLSVLDFVALFPSTNPNIYSRGAMQKNSRQIYSSISGTVTPNTQTWKDINNRLASQEYKGELVAAEVQSYARIDALAPWFDRNSGTTYNTGWVGNTSGGILRKITIDYSNPLTKVNIGDQRTPFYFQLTHENGSAIPQFGQDDPRLKKRTFEFPNQKISDIQAFGKSTAPGLDGIDAVVFGFTDRNLDSKHDLMRNMISSIPAEMYQGKSNFKPQMEPINAQQKAMKTDTTNSYLTYKVNSYKAQEYKIRYRVAANENSKISISQKSGTNFEKIGDTNISKTVNAEDTVKGEYGYYKIIEGPTVKLNYGQNELKLENTQGKFAIDRIELEPIQKDEIVFEDNFDGTNKGWIFYSGGGIVGGGVTGRAGMIPSGTNSIVYPSGIDYYSKYTLNMKVKLQSTDPNIKQKVKIYHTTTKGQMVSKEVELKGGEGYKELKLEFITGYTPSESNQIGIQSAVGGSNVLFDDVKLTGAKR

SEQ ID NO: 11 - protein, 773 aa, Artificial sequence
  variant of native sequence
METEKESIKKSSAKTSPQMDSRAWINNPYQGVSMGQFLNAFNGNQWKPLLEQIHNKGDAGSGTIAFLKGMMTTGLSLLPPPGSLLASVWDIFIPGTGVKDDMWLQIEKYVDEKIDSKINDYHKYLMGAQFNGAMEKVKEYQRVLQIYNNSKVSVKVEEPEAPVRDAVRKADSELASYIAVIQTPEKETDSVYQQITAPIFVQAANLHLLVLRDIIQFGEEWGIDKDQLKGYKDKQEKLIENYTDYSIKVYNDGLEKRINEADKIFGPEDGYGNPAKPGPEEAYTNTHRWNYINEYIREYTLSVLDFVALFPSTNPNIYSRGAMQKNSRQIYSSISGTVTPNTQTWKDINNRLASQEYKGELVAAEVQSYARIDALAPWFDRNSGTTYNTGWVGNTSGGILRKITIDYSNPLTKVNIGDQRTPFYFQLTHENGSAIPQFGQDDPRLKKRTFEFPNQKISDIQAFGKSTAPGLDGIDAVVFGFTDRNLDSKHDLMRNMISSIPAEMYQGKSNFKPQMEPINAQQKAMKTDTTNSYLTYKVNSYKAQEYKIRYRVAANENSKISISQKSGTNFEKIGDTNISKTVNAEDTVKGEYGYYKIIEGPTVKLNYGQNELKLENTQGKFAIDRIELEPIQKDEIVFEDNFDGTNKGWIFYSGGGIVGGGVTGRAGMIPSGTNSIVYPSGIDYYSKYTLNMKVKLQSTDPNIKQKVKIYHTTTKGQMVSKEVELKGGEGYKELKLEFITGYTPSESNQIGIQSAVGGSNVLFDDVKLTGAKR

SEQ ID NO: 12 - protein, 661 aa, Artificial sequence
  variant of native sequence
MDKKQKKILSMTLALGVLTGTYIPITSTALAETEKESIKKSSAKTSPQMDSRAWINNPYQGVSMGQFLNAFNGNQWKPLLEQIHNKGDAGSGTIAFLKGMMTTGLSLLPPPGSLLASVWDIFIPGTGVKDDMWLQIEKYVDEKIDSKINDYHKYLMGAQFNGAMEKVKEYQRVLQIYNNSKVSVKVEEPEAPVRDAVRKADSELASYIAVIQTPEKETDSVYQQITAPIFVQAANLHLLVLRDIIQFGEEWGIDKDQLKGYKDKQEKLIENYTDYSIKVYNDGLEKRINEADKIFGPEDGYGNPAKPGPEEAYTNTHRWNYINEYIREYTLSVLDFVALFPSTNPNIYSRGAMQKNSRQIYSSISGTVTPNTQTWKDINNRLASQEYKGELVAAEVQSYARIDALAPWFDRNSGTTYNTGWVGNTSGGILRKITIDYSNPLTKVNIGDQRTPFYFQLTHENGSAIPQFGQDDPRLKKRTFEFPNQKISDIQAFGKSTAPGLDGIDAVVFGFTDRNLDSKHDLMRNMISSIPAEMYQGKSNFKPQMEPINAQQKAMKTDTTNSYLTYKVNSYKAQEYKIRYRVAANENSKISISQKSGTNFEKIGDTNISKTVNAEDTVKGEYGYYKIIEGPTVKLNYGQNELKLENTQGKFAIDRIELEPI

SEQ ID NO: 13 - protein, 631 aa, Artificial sequence
  variant of native sequence
METEKESIKKSSAKTSPQMDSRAWINNPYQGVSMGQFLNAFNGNQWKPLLEQIHNKGDAGSGTIAFLKGMMTTGLSLLPPPGSLLASVWDIFIPGTGVKDDMWLQIEKYVDEKIDSKINDYHKYLMGAQFNGAMEKVKEYQRVLQIYNNSKVSVKVEEPEAPVRDAVRKADSELASYIAVIQTPEKETDSVYQQITAPIFVQAANLHLLVLRDIIQFGEEWGIDKDQLKGYKDKQEKLIENYTDYSIKVYNDGLEKRINEADKIFGPEDGYGNPAKPGPEEAYTNTHRWNYINEYIREYTLSVLDFVALFPSTNPNIYSRGAMQKNSRQIYSSISGTVTPNTQTWKDINNRLASQEYKGELVAAEVQSYARIDALAPWFDRNSGTTYNTGWVGNTSGGILRKITIDYSNPLTKVNIGDQRTPFYFQLTHENGSAIPQFGQDDPRLKKRTFEFPNQKISDIQAFGKSTAPGLDGIDAVVFGFTDRNLDSKHDLMRNMISSIPAEMYQGKSNFKPQMEPINAQQKAMKTDTTNSYLTYKVNSYKAQEYKIRYRVAANENSKISISQKSGTNFEKIGDTNISKTVNAEDTVKGEYGYYKIIEGPTVKLNYGQNELKLENTQGKFAIDRIELEPI

SEQ ID NO: 14 - protein, 831 aa, Unknown
  Bacillus sp. obtained from an environmental sample
MAQLRELQTQSIIPYNILATPPIGNADTQPASLDDLIESLKEAWIEFQKTGSDALLQSVLQNGFSAAGGGSFNYLAVLQAGIGILGTMLGAEIPGVAVAAPILSMVIGWLWPHKTQDDTQQLINLIDAEIQKQLNKALSEQDKNNWTGYLNAIFQISNDASRSVVDAQFTGNEGDATRQPRTPGVSDYENVYNHLLATQGSLIVALSQMINGNFDTLAIPFFVIGATVQLSTYQSFIQFANKWLPIVYPDYQTQGTAGYTQQQNLINAKSDMRAAIQNHTQKVFNAFKAGLPSLSSDKNSISVYNQYVRGLVLNGLDTVATWPSMYPDDYRTQTELEQTRVIFSDLIGKDQTISNDVTLINMADGKNGSGAFNQHATIDLNSIFYYHEELSSIQLGIHDGNRGNTTNCYDYGIITNYPNYSYFYGDLYSPSGDATFSAPLNVLNAQTQYSSGYVDSEFIYNSDPSAYGAGCHILGGCTKGDCYNQSSCSEGFGYSCNPSLPSQKINAFYPFKMNLSRSGTSDKLGLMYSLVPLDLNPNNTFGELDSNTGNVIGKGFPAEKGTLASGNVPTVVREWVNGANAVKLSDDALTLKMTNMTGGKYYIRVRYANTSNAEISINQSVSAGNQNIQNGPWGLPSTITSVVSDASFKKLYIAGQTGNYVLEDITWGVDGQGKPITIPSGDVTVTLSRTNMSQSGDLFIDRVELVPMSLQTYTVNYTITSSLPSWDDFNHDANDINSFPTVWKADANQSVSKFIASAQDLPQLHSVVPIGLSTNGSWSELRDANLDDLISSGTQNVAYSMQDGSSFTELKLGSSEYQMAASSGTITGTLI

SEQ ID NO: 15 - protein, 708 aa, Artificial sequence
  variant of native sequence
MAQLRELQTQSIIPYNILATPPIGNADTQPASLDDLIESLKEAWIEFQKTGSDALLQSVLQNGFSAAGGGSFNYLAVLQAGIGILGTMLGAEIPGVAVAAPILSMVIGWLWPHKTQDDTQQLINLIDAEIQKQLNKALSEQDKNNWTGYLNAIFQISNDASRSVVDAQFTGNEGDATRQPRTPGVSDYENVYNHLLATQGSLIVALSQMINGNFDTLAIPFFVIGATVQLSTYQSFIQFANKWLPIVYPDYQTQGTAGYTQQQNLINAKSDMRAAIQNHTQKVFNAFKAGLPSLSSDKNSISVYNQYVRGLVLNGLDTVATWPSMYPDDYRTQTELEQTRVIFSDLIGKDQTISNDVTLINMADGKNGSGAFNQHATIDLNSIFYYHEELSSIQLGIHDGNRGNTTNCYDYGIITNYPNYSYFYGDLYSPSGDATFSAPLNVLNAQTQYSSGYVDSEFIYNSDPSAYGAGCHILGGCTKGDCYNQSSCSEGFGYSCNPSLPSQKINAFYPFKMNLSRSGTSDKLGLMYSLVPLDLNPNNTFGELDSNTGNVIGKGFPAEKGTLASGNVPTVVREWVNGANAVKLSDDALTLKMTNMTGGKYYIRVRYANTSNAEISINQSVSAGNQNIQNGPWGLPSTITSVVSDASFKKLYIAGQTGNYVLEDITWGVDGQGKPITIPSGDVTVTLSRTNMSQSGDLFIDRVELVPM

SEQ ID NO: 16 - protein, 796 aa, Unknown
  Bacillus sp. obtained from an environmental sample
VKKVNSYKNENEYEYEILDTSQNNSNMSNRYPRYPLANNPQTPMRNVNYKEWLNMCDSNTKFVGDINTYSSPKAALSVQNAIVTGISISGTVFLVIGSPVLGQSLLLISRLINLLWSVFRPLEPWEELMALVEELINQRIEVVIKNNALASLDGLQQIMELYRIRLSAWVNNKNDQTKMAVREQHRIVDNFLEVNMARFRISGSEVLLLPVYAQAANLHLILLRDIDLFGAEWGIGPEQIRDDYIRLQRYIREYKDHCVIFYNQGLNQFNRSTAQEWIRFNRFRREMTLTVLDLASFFPNYDPRIYPTAVKTELTREIYTDLIGNSTFSPWWNQTVTSFSTIESSVIRRPSFTTWLNRIRVFTGSLNPRISPAYVWGGHELVENRSNGSEITHVFGNTASLTPIQFLSFANVSVFRINSLARSDTQAHTNYGVSRAIFHTSDINNAPGSVAYEVPNNNSSSPMVSELPRENEQRPNEREFSHRLSYISHVRARRYNSGTNGNIDLLMYGWTHTSMNRNNRLEPDGITQIDAVKGVGGTVSGVVIPGPTGGNLVNPGASPAIFSLRVQAPQIPTSYRIRLRYACLSRSPSRIWVHHSGNFHFVELPCNNVSGRPSNTLLESDFHYVDVPGVFSPSINPEILFQDHSFGTVLDKIEFIPIPLLPEGFRIVTALNNNFVIDLNPNNNVTMWNNNGGDNQRWRFTYDQQRNAYVIRNLRNPDLALTWDTTSSSVVAAKISPERREQYWVLENFQNGYVLLNLRDTGRVLDVAGGSVGSGTNLIVYPRHNGNGQIFFIRKP

SEQ ID NO: 17 - protein, 793 aa, Artificial sequence
  variant of native sequence
MNSYKNENEYEYEILDTSQNNSNMSNRYPRYPLANNPQTPMRNVNYKEWLNMCDSNTKFVGDINTYSSPKAALSVQNAIVTGISISGTVFLVIGSPVLGQSLLLISRLINLLWSVFRPLEPWEELMALVEELINQRIEVVIKNNALASLDGLQQIMELYRIRLSAWVNNKNDQTKMAVREQHRIVDNFLEVNMARFRISGSEVLLLPVYAQAANLHLILLRDIDLFGAEWGIGPEQIRDDYIRLQRYIREYKDHCVIFYNQGLNQFNRSTAQEWIRFNRFRREMTLTVLDLASFFPNYDPRIYPTAVKTELTREIYTDLIGNSTFSPWWNQTVTSFSTIESSVIRRPSFTTWLNRIRVFTGSLNPRISPAYVWGGHELVENRSNGSEITHVFGNTASLTPIQFLSFANVSVFRINSLARSDTQAHTNYGVSRAIFHTSDINNAPGSVAYEVPNNNSSSPMVSELPRENEQRPNEREFSHRLSYISHVRARRYNSGTNGNIDLLMYGWTHTSMNRNNRLEPDGITQIDAVKGVGGTVSGVVIPGPTGGNLVNPGASPAIFSLRVQAPQIPTSYRIRLRYACLSRSPSRIWVHHSGNFHFVELPCNNVSGRPSNTLLESDFHYVDVPGVFSPSINPEILFQDHSFGTVLDKIEFIPIPLLPEGFRIVTALNNNFVIDLNPNNNVTMWNNNGGDNQRWRFTYDQQRNAYVIRNLRNPDLALTWDTTSSSVVAAKISPERREQYWVLENFQNGYVLLNLRDTGRVLDVAGGSVGSGTNLIVYPRHNGNGQIFFIRKP

SEQ ID NO: 18 - protein, 658 aa, Artificial sequence
  variant of native sequence
VKKVNSYKNENEYEYEILDTSQNNSNMSNRYPRYPLANNPQTPMRNVNYKEWLNMCDSNTKFVGDINTYSSPKAALSVQNAIVTGISISGTVFLVIGSPVLGQSLLLISRLINLLWSVFRPLEPWEELMALVEELINQRIEVVIKNNALASLDGLQQIMELYRIRLSAWVNNKNDQTKMAVREQHRIVDNFLEVNMARFRISGSEVLLLPVYAQAANLHLILLRDIDLFGAEWGIGPEQIRDDYIRLQRYIREYKDHCVIFYNQGLNQFNRSTAQEWIRFNRFRREMTLTVLDLASFFPNYDPRIYPTAVKTELTREIYTDLIGNSTFSPWWNQTVTSFSTIESSVIRRPSFTTWLNRIRVFTGSLNPRISPAYVWGGHELVENRSNGSEITHVFGNTASLTPIQFLSFANVSVFRINSLARSDTQAHTNYGVSRAIFHTSDINNAPGSVAYEVPNNNSSSPMVSELPRENEQRPNEREFSHRLSYISHVRARRYNSGTNGNIDLLMYGWTHTSMNRNNRLEPDGITQIDAVKGVGGTVSGVVIPGPTGGNLVNPGASPAIFSLRVQAPQIPTSYRIRLRYACLSRSPSRIWVHHSGNFHFVELPCNNVSGRPSNTLLESDFHYVDVPGVFSPSINPEILFQDHSFGTVLDKIEFIPI

SEQ ID NO: 19 - protein, 655 aa, Artificial sequence
  variant of native sequence
MNSYKNENEYEYEILDTSQNNSNMSNRYPRYPLANNPQTPMRNVNYKEWLNMCDSNTKFVGDINTYSSPKAALSVQNAIVTGISISGTVFLVIGSPVLGQSLLLISRLINLLWSVFRPLEPWEELMALVEELINQRIEVVIKNNALASLDGLQQIMELYRIRLSAWVNNKNDQTKMAVREQHRIVDNFLEVNMARFRISGSEVLLLPVYAQAANLHLILLRDIDLFGAEWGIGPEQIRDDYIRLQRYIREYKDHCVIFYNQGLNQFNRSTAQEWIRFNRFRREMTLTVLDLASFFPNYDPRIYPTAVKTELTREIYTDLIGNSTFSPWWNQTVTSFSTIESSVIRRPSFTTWLNRIRVFTGSLNPRISPAYVWGGHELVENRSNGSEITHVFGNTASLTPIQFLSFANVSVFRINSLARSDTQAHTNYGVSRAIFHTSDINNAPGSVAYEVPNNNSSSPMVSELPRENEQRPNEREFSHRLSYISHVRARRYNSGTNGNIDLLMYGWTHTSMNRNNRLEPDGITQIDAVKGVGGTVSGVVIPGPTGGNLVNPGASPAIFSLRVQAPQIPTSYRIRLRYACLSRSPSRIWVHHSGNFHFVELPCNNVSGRPSNTLLESDFHYVDVPGVFSPSINPEILFQDHSFGTVLDKIEFIPI

SEQ ID NO: 20 - protein, 790 aa, Unknown
  Bacillus sp. obtained from an environmental sample
VKKMNSYQNKNEYEILDASENTVNALNRYPFANNPYSSIFSSCPRSGPGNWINILGNAVSEAVSISQDIISLLTQPSISGIISMAFSLLSRMIGSNGRSISELSMCDLLAIIDLRVNQSVLDDGVADFNGSLVIYRNYLEALQRWNNNPNPANAEEVRTRFRESDTIFDLILTQGSLTNGGSLARNNAQILLLPSFANAAYFHLLLLRDANVYGNNWGLFGVTPNINYESKLLNLIRLYTNYCTHWYNQGLNELRNRGSNATAWLEFHRFRRDMTLMVLDIVSSFSSLDITRYPRATDFQLSRIIYTDPIGFVNRSDPSAPRTWFSFHNQANFSALESGIPSPSFSQFLDSMRISTGPLSLPASPNIHRARVWYGNQNNFNGSSSQTFGEITNDNQTISGLNIFRIDSQAVNLNNTTFGVSRAEFYHDASQGSQRSIYQGFVDTGGASTAVAQNIQTFFPGENSSIPTPQDYTHILSRSTNLTGGLRQVASGRRSSLVLHGWTHKSLSRQNRVEPNRITQVPAVKASSPSNCTVIAGPGFTGGDLVRMSSNCSVSYNFTPADQQVVIRLRYACQGTASLRITFGNGSSQIIPLVSTTSSINNLQYENFSFASGPNSVNFLSAGTSITIQNISTNSNVVLDRIEIVPEQPIPIIPGDYQIVTALNNSSVFDLNSGTRVTLWSNNRGAHQIWNFMYDQQRNAYVIRNVSNPSLVLTWDFTSPNSIVFAAPFSPGRQEQYWIAESFQNSYVFENLRNTNMVLDVAGGSTAIGTNIIAFPRHNGNAQRFFIRRP

SEQ ID NO: 21 - protein, 647 aa, Artificial sequence
  variant of native sequence
VKKMNSYQNKNEYEILDASENTVNALNRYPFANNPYSSIFSSCPRSGPGNWINILGNAVSEAVSISQDIISLLTQPSISGIISMAFSLLSRMIGSNGRSISELSMCDLLAIIDLRVNQSVLDDGVADFNGSLVIYRNYLEALQRWNNNPNPANAEEVRTRFRESDTIFDLILTQGSLTNGGSLARNNAQILLLPSFANAAYFHLLLLRDANVYGNNWGLFGVTPNINYESKLLNLIRLYTNYCTHWYNQGLNELRNRGSNATAWLEFHRFRRDMTLMVLDIVSSFSSLDITRYPRATDFQLSRIIYTDPIGFVNRSDPSAPRTWFSFHNQANFSALESGIPSPSFSQFLDSMRISTGPLSLPASPNIHRARVWYGNQNNFNGSSSQTFGEITNDNQTISGLNIFRIDSQAVNLNNTTFGVSRAEFYHDASQGSQRSIYQGFVDTGGASTAVAQNIQTFFPGENSSIPTPQDYTHILSRSTNLTGGLRQVASGRRSSLVLHGWTHKSLSRQNRVEPNRITQVPAVKASSPSNCTVIAGPGFTGGDLVRMSSNCSVSYNFTPADQQVVIRLRYACQGTASLRITFGNGSSQIIPLVSTTSSINNLQYENFSFASGPNSVNFLSAGTSITIQNISTNSNVVLDRIEIVPE

SEQ ID NO: 22 - protein, 861 aa, Unknown
  Bacillus sp. obtained from an environmental sample
MGFLPIIICSSRRNFMAQLQELQIQPVIPYNVLASPQIGNLDTQPGSLDDLIESLKEAWTEFQKTGSDKLLQTTLQNGFSAASGGSFNYLAVLQAGIGLFGTLGAEIPGVAVAAPILSMVIGWLWPHKSGDDGQQLVDLIDAEIQKQLNQALSTQDKHNWVGYLDESFLNASHNVARAVTNAQFVGTEGNYTAPRTPTASDYTTVETTLFSTEGSYHTGLSQMLNGNFDTLALPFYVIGVTMQLATYQTFIQFGEKWIDVVWPDNQTPGTTGYTHYQTLQDKKTDMRTFIQQHTTTVYNAFKKGMPPLESNKNSINAYNVYVRGMVLNGLDMVATWPSMYPDDYPTQMALEQTRVIFSDMVGQDQTRDGNTTIYNIFDSTSNFQHGTTDINSIHYFPDELQQAQIAEYSPSRGNHCYPYGIILNYQHNTYRYGDNDPGTSGTVFPAPMRSINAKTQNTSYLNSENLFTDLGSSTNCYIPGTCTNNCSPGSSCTNGSGYGESCNVPLPNQKINALYPFTQEHVSGDSGKLGLMASLVPYGLSPNNVFGEFDSDTQAIIGKGFPAEKGYIGNGSPVSVVREWVNGANAVQLPAWDTFKITATNLAADQYHIRVRYASTAAYPTNAKYPLSYYVLAGDTILQQGKWEAIDTSQADITKQVYVTGQQGNYILTDILGENPITLPKDEITVQLLQGNPAGGMTKVLIDRIEFVPAVINVLNPQLNYQISSQLPAWNNNQSMDPFPTIWRANPGIVGTSANITVADLLDMSGFKYTNITALDLGGQVGLFAKIGIGTDSDPNNWKWMCPDGQGENPWIGDGTYNFNPKNSGSCFDKSFTAIKLVGGTSFDTFIAAGILTGTVTTQKS

SEQ ID NO: 23 - protein, 710 aa, Artificial sequence
  variant of native sequence
MGFLPIIICSSRRNFMAQLQELQIQPVIPYNVLASPQIGNLDTQPGSLDDLIESLKEAWTEFQKTGSDKLLQTTLQNGFSAASGGSFNYLAVLQAGIGLFGTLGAEIPGVAVAAPILSMVIGWLWPHKSGDDGQQLVDLIDAEIQKQLNQALSTQDKHNWVGYLDESFLNASHNVARAVTNAQFVGTEGNYTAPRTPTASDYTTVETTLFSTEGSYHTGLSQMLNGNFDTLALPFYVIGVTMQLATYQTFIQFGEKWIDVVWPDNQTPGTTGYTHYQTLQDKKTDMRTFIQQHTTTVYNAFKKGMPPLESNKNSINAYNVYVRGMVLNGLDMVATWPSMYPDDYPTQMALEQTRVIFSDMVGQDQTRDGNTTIYNIFDSTSNFQHGTTDINSIHYFPDELQQAQIAEYSPSRGNHCYPYGIILNYQHNTYRYGDNDPGTSGTVFPAPMRSINAKTQNTSYLNSENLFTDLGSSTNCYIPGTCTNNCSPGSSCTNGSGYGESCNVPLPNQKINALYPFTQEHVSGDSGKLGLMASLVPYGLSPNNVFGEFDSDTQAIIGKGFPAEKGYIGNGSPVSVVREWVNGANAVQLPAWDTFKITATNLAADQYHIRVRYASTAAYPTNAKYPLSYYVLAGDTILQQGKWEAIDTSQADITKQVYVTGQQGNYILTDILGENPITLPKDEITVQLLQGNPAGGMTKVLIDRIEFVPA

SEQ ID NO: 24 - protein, 209 aa, Unknown
  Bacillus sp. obtained from an environmental sample
LTSYNIVLSPKKDGMRLFWQKSNDFERRMIMQDFDYFEQPHSDESIPRQPDPRPKQAPQPTVSFQCVVEIPRGYRVVSHGLTQFLYDMSGLSISQETGKKTINVEEYGQIEVDLHTLSLRGCISISTNIDIQPEQQTHIGFVGHNTNTIQFYFTDIISISTVLQHSVTPLPHYTVDHRHIKVDNLQLEPFDTANPRLWKLTGLFAFLMK

SEQ ID NO: 25 - protein, 1177 aa, Unknown
  Unknown organism from environmental sample
MDCNLQSQQNIPYNVLAIPVSNVNSLTDTIGDLKKAWEEFQKTGSFSLTALQQGFNAAQGGTFNYLTLLQSGISLAGSFVPGGTFVAPIINMVIGWLWPHKNKNADTENLINLIDSEIQKQLNKALLDQDRQDWISYLESIFDSSNNLNGAIIDAQWSGTVNTTNRTLRNPTESDYLNVVTNFIAADGDISSNEHHIMNGNFDVAAAPYFVIGATARFATMQSYIKFCNAWIDKVGLSDSQLTTQKANLDRTKQTIRNAILSYTQQVMKVFKDPKNMPTIDTNKFSVDTYNVYVKGMTLNVLDIVAIWPSLYPDDYTSQTSLEQTRVTFSNMVGQEEGTDGTVTIYNTFDSDSYRHKAIPNNDVNLLSYFPDELQNVQLALYTPSKKDSGYTYPYAFISNYQYSRYQYGDNAPEGPLSTLSAPIQSINAATQNTKYLDGETINGIGANLPGYCTSDCSPTQQPFSCTSTVNQFKQSCNPTDTNQKINALYAFTQTNVKGNQGKLGLLASHVPYDLNPKNIFGELDPDTNNVILKGIPAEKGYFSNNTRPNIVKEWINGANAVPLDSGNTLFMTATNVTATQYKIRIRYANPNSNTQIGVQISQNGSIISNSNLTLYSTTDMNNTLPLNVYVTGENGNYTLLDLYSTTNVLSTGDITLKLTGGDQKIFIDRIEFVPTMPVPGNTNNNNGDNGNNNPVHHVCAIAGTQQSCSGPPKFEQVSNLEKITTQVYMLFKSSPYEELAPEVSSYQISQVALKVMALSDELFCKEKSLLRKLVNKAKQLLEASNLLVGGNFETTQNWVLGTNAYINYDSFLFNGNYLSLQPASGFFTSYAYQKIDESTLKPYTRYKVSGFIGQSNQVELIISRYGKEIDKILNVPYAGPLPITANALITCCAPEIGQCDGKQSDSHFFNYSIDVGALHLELNPGIEIGLKIVQSNGYITISNLEIIEERPLTEMEIQAVNRKSQKWEREKLLECASINELLQPVINQIDSLFKDGNWYNDILPHITYQDLKNIIIPELPKLKHWFIEDLPGEYHEIEQKMKEALKHAFTQLDERNLIHNGHFTINLIDWQVEGDAQMKVLENDALALQLFNWDSSASQSIKILEFDEDKAYKLRVYAQGNGTIQFGNCEDEAIQFNTNSFIYQEKIVYFDTPSINVKIQSEGAEFVVSSVELIEL

SEQ ID NO: 26 - protein, 676 aa, Artificial sequence
  variant of native sequence
MDCNLQSQQNIPYNVLAIPVSNVNSLTDTIGDLKKAWEEFQKTGSFSLTALQQGFNAAQGGTFNYLTLLQSGISLAGSFVPGGTFVAPIINMVIGWLWPHKNKNADTENLINLIDSEIQKQLNKALLDQDRQDWISYLESIFDSSNNLNGAIIDAQWSGTVNTTNRTLRNPTESDYLNVVTNFIAADGDISSNEHHIMNGNFDVAAAPYFVIGATARFATMQSYIKFCNAWIDKVGLSDSQLTTQKANLDRTKQTIRNAILSYTQQVMKVFKDPKNMPTIDTNKFSVDTYNVYVKGMTLNVLDIVAIWPSLYPDDYTSQTSLEQTRVTFSNMVGQEEGTDGTVTIYNTFDSDSYRHKAIPNNDVNLLSYFPDELQNVQLALYTPSKKDSGYTYPYAFISNYQYSRYQYGDNAPEGPLSTLSAPIQSINAATQNTKYLDGETINGIGANLPGYCTSDCSPTQQPFSCTSTVNQFKQSCNPTDTNQKINALYAFTQTNVKGNQGKLGLLASHVPYDLNPKNIFGELDPDTNNVILKGIPAEKGYFSNNTRPNIVKEWINGANAVPLDSGNTLFMTATNVTATQYKIRIRYANPNSNTQIGVQISQNGSIISNSNLTLYSTTDMNNTLPLNVYVTGENGNYTLLDLYSTTNVLSTGDITLKLTGGDQKIFIDRIEFVPT

SEQ ID NO: 27 - protein, 1242 aa, Unknown
  Bacillus sp. obtained from an environmental sample
MNGGENMNQNDQNEIQIIDSSSNDFNQSNRYPRYPLAEESNYKDWLANCKESNLDRLSTPSSVQDAVVTSLNIFSYIFGFLDFGATSAGLGILGALFGVFWPSSNNGISEDLLRSIEILIDRRINEVERNRITVQFEGLRAVMSNYNTALRNWNANRNNPALQSEVRSRFDNADDAFAGRMPEFRIPGFEIQSLSVYAQAATLHLLLLRDAVVNGSLWGFDGETIESYYTKLVCLIDAYADHCASFYRQGLQELRDRGNWNAFNNYRRDMTITVLDIISLFSNYDPRRYTINTNTQLTREVYTEPVATPGWLNLNSNPDQFQQIENDLIRPLRPSSTLAALSAETAFAFFQSGQTPLRAILRTRTSHFNISGGFGTDPWQGSPNPTGPSESQLQFENFDVYHVSSEVTREVSSENSGLFGPQRINFRMVSISGVVASREISSPPFGRYITNISSSIPGIRSANPTASDYTHRLSSIRSTSLRTMYRDRTNIIAYGWTHTSLELTNRLLPNRITQIPAVKSSITPLPIVGGPGHTGGGLVSLAGYGRYMLINFISPYSPSRQRYRLRIRFVKDFDDAHLRVSISAANFYQNVVLPGSRTSVNPNLSFRDFRYVDVPGEFELVANRSYSINLGAPTSSIPGTCLIDKIEFIPVNSAALEYEGEQSLKKAKKAVDDLFTNDLKNDLKIETTDYDVDQAANLVECVPEELYAKEKMILLDEVKHAKQLSESRNLIQNGNFEFYTDKWTTSNNASIQADNPIFKGNYLNMPGARETEAGATTFPTYVFQKIDESKLKPYTRYKARGFVGGSKEVRLIVARYAEEVDAIMNVRNDLTPGVPVASCGEFDRCHPQAYPILQDRCHDDRIEQHADGGSHSCHGKSREKHAICHDSHQFDFHIDTGEVYLTENPGIWVLFKISSPEGYATLDNIELIEEGPLVGESLALVKKREKKWKNEMETKWIHTKEAYEKAKWAVDALFTTPQDTALKFETIISNIISAEHLVQSIPYVYNKWLADVPGMNYDIYTELKRRITQAYSLYERRNIIKNGDFHQGLAHWHATPHARVQQIDGTAVLVIPNWGSNVSQNLCVEHNRGYVLRVTAKKEDMGKGYVTISDCAKNTETLTFTSCDYVSNTSTSDHPRTCNSCDDYVSNESINDQPDYLLNQERNESRCYNRNASTSEESDYLLNQKRNEQWSNHSDATVNEQMNYVTRTIDFFPDTDRVRIDIGETEGIFKVESVELICMEGQ

SEQ ID NO: 28 - protein, 651 aa, Artificial sequence
  variant of native sequence
MNGGENMNQNDQNEIQIIDSSSNDFNQSNRYPRYPLAEESNYKDWLANCKESNLDRLSTPSSVQDAVVTSLNIFSYIFGFLDFGATSAGLGILGALFGVFWPSSNNGISEDLLRSIEILIDRRINEVERNRITVQFEGLRAVMSNYNTALRNWNANRNNPALQSEVRSRFDNADDAFAGRMPEFRIPGFEIQSLSVYAQAATLHLLLLRDAVVNGSLWGFDGETIESYYTKLVCLIDAYADHCASFYRQGLQELRDRGNWNAFNNYRRDMTITVLDIISLFSNYDPRRYTINTNTQLTREVYTEPVATPGWLNLNSNPDQFQQIENDLIRPLRPSSTLAALSAETAFAFFQSGQTPLRAILRTRTSHFNISGGFGTDPWQGSPNPTGPSESQLQFENFDVYHVSSEVTREVSSENSGLFGPQRINFRMVSISGVVASREISSPPFGRYITNISSSIPGIRSANPTASDYTHRLSSIRSTSLRTMYRDRTNIIAYGWTHTSLELTNRLLPNRITQIPAVKSSITPLPIVGGPGHTGGGLVSLAGYGRYMLINFISPYSPSRQRYRLRIRFVKDFDDAHLRVSISAANFYQNVVLPGSRTSVNPNLSFRDFRYVDVPGEFELVANRSYSINLGAPTSSIPGTCLIDKIEFIPV

SEQ ID NO: 29 - protein, 661 aa, Unknown
  Bacillus sp. obtained from an environmental sample
MNKNNNSSELDINDTGASHPSNSIVEVPCSECGGIDYRDVMNMSTQNAYVEQQSVVGAATTTSFQVIRELYRSNKDILSTAGGIIKSISVFLWKKEHAQTQWEEFMKSVELMIDEKIDTAVMAAAISRVASLEALLAVHQDYLDILAADPSNPDLQELVSDHVVNLQDFFVYTMPQLSQSPYQVQQLVAYAEAANLHLAFLRDVVMFGSQWGMQQATIDTYYKYLENNIKVYTNYCVNTYNIGLEKTKNLMGSINPKNYDKYPYLNPHANNSTNNYKKVLQWNVWNDFRRNMTIMVLDLVVVFPTYDPKVYTNLEGIEIELSREVYSTSYNRYGDSTHGGDWKGWEILETSVVRPPHLVSFLSNLAFYMANYANAPTNTGLDQYNGVINTLRNIDSTSTWEDGFAPITKKEYTTVKDIPGDFIKEINMNSGVDPCFLNFITNSSGTHSVGTCYRSPIQGPIYNLSATIPYHRLSYVNGMDDNFSESFSGWGISAWGFGWLHESLKTSNVIHATRSSFIPAVKSYGLWGGATVIKGPGSTGGDLVRLPAAPGVIQVRLPVTRQAVKQYKIRIRYAAQENGELFVGKWANRWWETANLSLIKTTSSNTPSYSEFKLIDAFIMTTNESAFQIELRNDSGGPILIDRIEFIPIQGTLEGYEATQN

SEQ ID NO: 30 - protein, 649 aa, Artificial sequence
  variant of native sequence
MNKNNNSSELDINDTGASHPSNSIVEVPCSECGGIDYRDVMNMSTQNAYVEQQSVVGAATTTSFQVIRELYRSNKDILSTAGGIIKSISVFLWKKEHAQTQWEEFMKSVELMIDEKIDTAVMAAAISRVASLEALLAVHQDYLDILAADPSNPDLQELVSDHVVNLQDFFVYTMPQLSQSPYQVQQLVAYAEAANLHLAFLRDVVMFGSQWGMQQATIDTYYKYLENNIKVYTNYCVNTYNIGLEKTKNLMGSINPKNYDKYPYLNPHANNSTNNYKKVLQWNVWNDFRRNMTIMVLDLVVVFPTYDPKVYTNLEGIEIELSREVYSTSYNRYGDSTHGGDWKGWEILETSVVRPPHLVSFLSNLAFYMANYANAPTNTGLDQYNGVINTLRNIDSTSTWEDGFAPITKKEYTTVKDIPGDFIKEINMNSGVDPCFLNFITNSSGTHSVGTCYRSPIQGPIYNLSATIPYHRLSYVNGMDDNFSESFSGWGISAWGFGWLHESLKTSNVIHATRSSFIPAVKSYGLWGGATVIKGPGSTGGDLVRLPAAPGVIQVRLPVTRQAVKQYKIRIRYAAQENGELFVGKWANRWWETANLSLIKTTSSNTPSYSEFKLIDAFIMTTNESAFQIELRNDSGGPILIDRIEFIPI

SEQ ID NO: 31 - protein, 404 aa, Unknown
  Bacillus sp. obtained from an environmental sample
LQTKLEGNIMKSISKKVMAGLLVGATSLSIWAPASQAAAPENNRYYSVHLAADTALKWDVYGNGTYDDAGILLYNGSLGDNEQFVFFPLDGGLYAIVNKNSGKAVTIGGGWVGDNAFSYNREGLIQSKWTGAAANKWYLRDKGNTNYEIVNQGYGKVASYARLGITGAKYVDLDDSNPSDNDRLFRINKSPLGVDIPGFNFDYGTFSLPQLPATGNRPDAPNYTGGIDQQLPQTSNSVIVGASLVPCIMVNDSQASDYTKIHNSPYYTLVKEEYWDKTFSAVLPAGITRNYSFKTGMTSVDQQKMTDTLSMKIGADFGLKFGDASASLKTEISRTIQTEITSTNTEASEETVTSTVASEAGKTTGFTEYQLATKYTLKRADGSIVSDPWVVKNNKITIARKNAQ

SEQ ID NO: 32 - protein, 366 aa, Artificial sequence
  variant of native sequence
MPENNRYYSVHLAADTALKWDVYGNGTYDDAGILLYNGSLGDNEQFVFFPLDGGLYAIVNKNSGKAVTIGGGWVGDNAFSYNREGLIQSKWTGAAANKWYLRDKGNTNYEIVNQGYGKVASYARLGITGAKYVDLDDSNPSDNDRLFRINKSPLGVDIPGFNFDYGTFSLPQLPATGNRPDAPNYTGGIDQQLPQTSNSVIVGASLVPCIMVNDSQASDYTKIHNSPYYTLVKEEYWDKTFSAVLPAGITRNYSFKTGMTSVDQQKMTDTLSMKIGADFGLKFGDASASLKTEISRTIQTEITSTNTEASEETVTSTVASEAGKTTGFTEYQLATKYTLKRADGSIVSDPWVVKNNKITIARKNAQ

SEQ ID NO: 33 - protein, 717 aa, Unknown
  Bacillus sp. obtained from an environmental sample
VWSVDLKENIYWKGVIKMSSYNKNPFETIKELLSNANVSITCPLHPLAKEPTAVLQGMNYKDWLVMSEEENSLGKPENFDSETIQNALIGTLAVIGFIASVLITPITGGASVAIGSALLLETIPYYWGLAESEDPTIQEKAMFDDIMKATEKTIKSEIEKVVKTKAESELTSLRDVFKYYTRALNLWKENKDNQDARKEVSSRFRAAHVAFIGAMSQFKMPGYELVMLPIYAAAANFHLMLLQDGMIYEKEWNESNNLTEDFYYKEYQNWTSQYIDHCTSWYQKGLKDIKDNKEKNWVDYNSYRNNMTILVLDLIALFPSYDVRQYNNMGVKLETHTRTLYSNPLKFSKGSRIDDDERVYTREPNLFSSLSHLEFHTRTTNLGSDGIEFLSGIEKKYQLTEKESYRTKFEGKPTDIGKKHEIPFKKDESEFYSLYELSTEGKGFKDSTKLPLIQKMTFNNEEGKKFEYSVDKFGNGALEKESFSITNPDDLLADQKARHVLSDIIFVDDKNISPEQIQTRDYSFAWTSEQISPYNRITDGTKNKDGSISYQITQVPAVKAYSLKSSKDTSHIDVISGPGFTGGDLVRCAIKKTASSTGVTQLSIVFPITFNHVKTDKYRVRMNYAADHTKLITLVGGSNPISGTIENTFDAKDTGKSLKYNNFKMMEFNIATNFKDEEKQKIITLKLTYADDDQAIADGKVAQLWIDKLEFIPVPTK

SEQ ID NO: 34 - protein, 714 aa, Artificial sequence
  variant of native sequence
VWSVDLKENIYWKGVIKMSSYNKNPFETIKELLSNANVSITCPLHPLAKEPTAVLQGMNYKDWLVMSEEENSLGKPENFDSETIQNALIGTLAVIGFIASVLITPITGGASVAIGSALLLETIPYYWGLAESEDPTIQEKAMFDDIMKATEKTIKSEIEKVVKTKAESELTSLRDVFKYYTRALNLWKENKDNQDARKEVSSRFRAAHVAFIGAMSQFKMPGYELVMLPIYAAAANFHLMLLQDGMIYEKEWNESNNLTEDFYYKEYQNWTSQYIDHCTSWYQKGLKDIKDNKEKNWVDYNSYRNNMTILVLDLIALFPSYDVRQYNNMGVKLETHTRTLYSNPLKFSKGSRIDDDERVYTREPNLFSSLSHLEFHTRTTNLGSDGIEFLSGIEKKYQLTEKESYRTKFEGKPTDIGKKHEIPFKKDESEFYSLYELSTEGKGFKDSTKLPLIQKMTFNNEEGKKFEYSVDKFGNGALEKESFSITNPDDLLADQKARHVLSDIIFVDDKNISPEQIQTRDYSFAWTSEQISPYNRITDGTKNKDGSISYQITQVPAVKAYSLKSSKDTSHIDVISGPGFTGGDLVRCAIKKTASSTGVTQLSIVFPITFNHVKTDKYRVRMNYAADHTKLITLVGGSNPISGTIENTFDAKDTGKSLKYNNFKMMEFNIATNFKDEEKQKIITLKLTYADDDQAIADGKVAQLWIDKLEFIPV

SEQ ID NO: 35 - protein, 1261 aa, Unknown
  Unknown organism from environmental sample
MSQNYNDEYEVIGTDERKNHPKYPLANTPGLELQQMSYKDWVDICTTEESESLFTDITVKDAVSIATSITAAVLGISFPVASAVSSIISVLVPYWWPASAGTPGTPSAQATWEKFMNAAEALSNKTIIASKRADALARWQGIQTLGRDYFQAQCDWLQDQNNELKKSNLRDAFDDVEDYLKVSMPFFRAQGFEIPMLAMYAQAANMHLLLLREVVQNGVSWGFQQYEIDRYYSNTDPFLGNPGLIQLLESYTDYCVQWYNNGLQQQYENNSYNWDAFNDFRRDMTIMVLDVVSLWPTYDQKRYPKPTKSQLTRTVYTDLVGFSGDFDYTQIAIDRAERELVQTPDLFTWIRKIVFNLLPGGTNFVRGRAMTFTYTDSINGYEENAGNPGEIQKIVNIPLPDTGDDVWRITNQVSPTSGALSGWIFSFIKSLDQRISWREPISSDIMLMQGLSCNGPSVDSCDLCDRNSPCRNITPNDSFPCNNKSLYSHRFSYLGAGLKSDLTTLTFFSYGWTHVSADANNLIDTKKITQIPAVKGSHLIGNAHVIKGTGSTGGDLVVLPIDSQVFVNVTTLESDTTIGYEIRIRYASATEVFLNVRIEQPDSPPIYRDVTLPATTSHSNLTYAAFNYYTIAKIGTVGATPGLTVLRLSNSINELGAIIDKIEFIPSEWSLEEYQTTQDLEEARKAVNALFMNDAKNALQLDVTDYAVDQAANLVECVSEDFHAQEKMILLDQVKFAKRLSQTRNLLNYGDFESSDWSGENGWRTSNHVHVASDNPIFKGRYLHMPGAMSPQFSNNIYPTYAYQKVDESKLKSYTRYLVRGFVGNSKDLELLVERYGKEVHVEMDVPNDIQYSLPMNECGGFNRCKPASYQTRPPHTCTCKDTAVAHTDCQCKDKVNRTSADVYTNESTSRGMYADEFHSHKSCGCGDKHMDKNGTHPHKSCGCKNSHVFTYHIDTGCVDMVENVGLFFALKIASENGIANIDNLEIIEAQPLTGEALARVKKREQRWKQERDQKRVETEKAVQAAQTAVQNLFTNAQQNRLKFETLFPQIVHAEALIQQIRYVYHPFLQGALPAIPGMNFDLVQELSMRIENARMLFETRNLIQNGSFSAGTGSWHVTDGVEVQPLQNTSVLVLSEWSHEASQQVRIDSDRGYVLRVTARKEGAGKGTVTLSDCADYMETLTFTSCDYNKVGSQTMTEGTLTGFVTKTLEIFPDTDQIRIDIGETEGTFKVESVELICMEQMEDHLYDRAGSVAKFSKRS

SEQ ID NO: 36 - protein, 667 aa, Artificial sequence
  variant of native sequence
MSQNYNDEYEVIGTDERKNHPKYPLANTPGLELQQMSYKDWVDICTTEESESLFTDITVKDAVSIATSITAAVLGISFPVASAVSSIISVLVPYWWPASAGTPGTPSAQATWEKFMNAAEALSNKTIIASKRADALARWQGIQTLGRDYFQAQCDWLQDQNNELKKSNLRDAFDDVEDYLKVSMPFFRAQGFEIPMLAMYAQAANMHLLLLREVVQNGVSWGFQQYEIDRYYSNTDPFLGNPGLIQLLESYTDYCVQWYNNGLQQQYENNSYNWDAFNDFRRDMTIMVLDVVSLWPTYDQKRYPKPTKSQLTRTVYTDLVGFSGDFDYTQIAIDRAERELVQTPDLFTWIRKIVFNLLPGGTNFVRGRAMTFTYTDSINGYEENAGNPGEIQKIVNIPLPDTGDDVWRITNQVSPTSGALSGWIFSFIKSLDQRISWREPISSDIMLMQGLSCNGPSVDSCDLCDRNSPCRNITPNDSFPCNNKSLYSHRFSYLGAGLKSDLTTLTFFSYGWTHVSADANNLIDTKKITQIPAVKGSHLIGNAHVIKGTGSTGGDLVVLPIDSQVFVNVTTLESDTTIGYEIRIRYASATEVFLNVRIEQPDSPPIYRDVTLPATTSHSNLTYAAFNYYTIAKIGTVGATPGLTVLRLSNSINELGAIIDKIEFIPS

SEQ ID NO: 37 - protein, 1164 aa, Unknown
  Unknown organism from environmental sample
MSEYELMDVSPNPYNVLMQRPDEAGGIDWDAEISKMIKTYYQKGTFAADFATIILPLILAHNVQWNVVLKSVLSFASALPGIGTAVSILSPFLQLLFPTDPAAHDKQLMKLILDQTKILIDQAVSQEVMNRISQQITGLYANLARFNRTIAAYETLAPSTIIAEIEAIEAVFDNQVPQLVDPGYLALTLPLYVQGVNLNLMFYKSVLDHAEQLKIPAGEQNFYKKSLIDKIKTASAQVYTYFKQVPWRPNEITPSSASNQDIVTRQTMYTHCLDYVAMWPTFNPDLYPLSADIEQTRVLSSPISGLLGKPGAYGPFVDFLGFDDTLELTSITYWQGDRVDRLDQNFTHGRVIRGGSGGGGSRHDIPSSRENPIASLWMDYNSNNYQFVSYQMYNTLIDYTKPQTNLLLAPPNHKLHRLYTTDDPSFGGRVGTIGNQFIQNTIFPENIMGTFDQDLGVRRIKGIPFEKSPSTTAFTYAKEPLNGAEAVKLGIRQTLDLPITNVTTGRYEVRIRYASTDTATIFVNLDVGGHQPIYKTVVLPATTTGDPTGIEGANGTYTLLTIQEISIPAGNFHVYVTNNTTNGSQLLLDRIEFVPILVPVVFIDEDFNGEMKTLWKSDTEQGIHINGMITSNENFALATDVSLPTTTDTDKGGPINEDYQPFHELYTWPLSPNLRGHITAAISLVSSQNKFTTEEELSAVTQVVNALFITDTQLAPTVTDYWIDQVYLKVKALSDDLFGEEKERLRQRVARAKQINTMKNKLIGSSFQTLTNWQLSSDVALLADNPLFAGTYVLLPPSTYPDTRPSYAYQKVDESKLKPYTRYIVRGFIGQAQDLALLVSRYGKEVDTALTVPYQEALPLSPDSTSNCCGPVACLPCEGHEYDTHLFSYTIDVGALQSEINLGIEIGFKITSPTGFAHISNLEIVEDRPLTEAETIKVKQREKKWMRLSQKQQSQMQAQYDQTMQYFANLYTTPDQTELKNTVQYTDIAKVQVVTFPSPMQWFIPQLPRSSSAMVQELINAKEKALQLYPTNLIQNGNFAADLSHWDVRQDTNVSIDTVDGTSVLHVPSWDETVSQTITLPPHQENILYQLRVTAKGNGSVILQHNGEQERLYFNQNNPNGNTFVTKTISFYPTASNLSIQIQSEGTDFYVKTIEVFVQPVPLT

SEQ ID NO: 38 - protein, 596 aa, Artificial sequence
  variant of native sequence
MSEYELMDVSPNPYNVLMQRPDEAGGIDWDAEISKMIKTYYQKGTFAADFATIILPLILAHNVQWNVVLKSVLSFASALPGIGTAVSILSPFLQLLFPTDPAAHDKQLMKLILDQTKILIDQAVSQEVMNRISQQITGLYANLARFNRTIAAYETLAPSTIIAEIEAIEAVFDNQVPQLVDPGYLALTLPLYVQGVNLNLMFYKSVLDHAEQLKIPAGEQNFYKKSLIDKIKTASAQVYTYFKQVPWRPNEITPSSASNQDIVTRQTMYTHCLDYVAMWPTFNPDLYPLSADIEQTRVLSSPISGLLGKPGAYGPFVDFLGFDDTLELTSITYWQGDRVDRLDQNFTHGRVIRGGSGGGGSRHDIPSSRENPIASLWMDYNSNNYQFVSYQMYNTLIDYTKPQTNLLLAPPNHKLHRLYTTDDPSFGGRVGTIGNQFIQNTIFPENIMGTFDQDLGVRRIKGIPFEKSPSTTAFTYAKEPLNGAEAVKLGIRQTLDLPITNVTTGRYEVRIRYASTDTATIFVNLDVGGHQPIYKTVVLPATTTGDPTGIEGANGTYTLLTIQEISIPAGNFHVYVTNNTTNGSQLLLDRIEFVPI

SEQ ID NO: 39 - protein, 456 aa, Unknown
  Bacillus sp. obtained from an environmental sample
MTQRLPQFEIDGYEEVSLPLFAEICTLHLTLLKDGVLMGPRWGLTTDDVKYYRDEFYRLTSNYNSRAVELYNRGFSNASNSLDFKKVVVYKTTMNEYALDLVYLWSLMRYEGITPSVSRSLWNFVGNRTYIPISKSDWNAQYKLMNGVVNSLLKSVTFRSSHIKFNGVWPKYRLQENITGWMGATQLDTDYIYQAPQSVPKDAVIAPGGGVKEKWHIKIGDTVVIPQPWYLPIKPIAYDGYYIRTISAYPTFIFPPNLDFSLGSKLELSVPNHTMAHGGNIILGFAPDNTKEFFTTGQHTFPQKGSYTIPPLQYTTINNPSQAFLNETLDQGTDGVLSLTGAANTNVIQYNINMLNVDQNKKYVLFLRIGGPGNINAIIKNAGQQSDVPSKRLGVFNNPNLYGWKDFVSTGFTFKLDDMGLPIPPVGLVLRKTNDAGMRILQVMIIPESDFKILIP

SEQ ID NO: 40 - protein, 505 aa, Unknown
  Bacillus sp. obtained from an environmental sample
VKHMNSEQRKHGQNNEYKHQNHGVSCNCGCQQGKYEYEQKQDREEYNNSYMSNEQTQNHEGMGYLVAKEGTRNDMYNSVKREFREHDMYHENKNYYSCSPRQFNTLNLPDESKRFQTITHVQNTNSNPSLNATSTTRGQNIDGSNNFCRSISLDFQLINQDLNTTQDTFYYLFYLLDSGDFIIANYGTGRVLENRTVEPDERAIISSLYTGSVSQFFRKRSSVNNQFILSPQQELNRAVNVCNNTINLATKITSGFNIPDNTSNVFRHIVASNRPITIPSFSNESTLGPAPVLTSLSDYGPSPAQAERAVIGSALIPCIFVNDVLPLERRIKESPYYVLEYRQYWHRLWTDEIPSGDRRSFGEITGILPNAQASMRDMIDMSIGADWGLRFGDSSTPFKRGILNSLNTQGSYADVDLGTQTGSNQLTNFNSFSVRYARFVKAHEYRLTRSNGTVVTTPWVALDYRVPQTARFPLNAQLSQNYKIISSYNSYDLPVLEHTDNKKKW

SEQ ID NO: 41 - protein, 720 aa, Unknown
  Bacillus sp. obtained from an environmental sample
LLIERGEIFMNQNNNEYEIADVNPPSYPSNRINNYSRYPFANDPNQLLQQTNYKDWLNICQGNNQNSGNLITDAGAAVSAGIIVTGTMIAAFAALAVAPFPIVGAIVGGIVIAFGTLLPLVWPGGKEDRTVWTQFFALGETLLGKRLTDDAQKTAAETVDGFGRVLDNYKVALNSWMDLKKKQSPGSPPTTELKEAADNVKQRFEIVHNEFDANMPHLGNPKSNYKEVLLSSYAHAANLHLNLLQQGVRFADQWNQDIYSSQIVPAAGTSTEYLKFLQARIQEYVNYCTATYRSGLNILKNSNDITWDIYNTYRRDMTLTVLDLVAAFPNYDPTYYPIDTKIQLTRTIYSNLLGITQSGRQYFEALENALTMRPNLYRILRGFNFNTTFGSGVNYLSGIANRRGLIKTVPSEEDEQPFYGQSNGRHDPMIFANGLNIFRVTLLRNKHYIALPVGPPLFAANQITDLKLYYGNATQYHHYQPSNEGLTTESTDLSFPPKNEEYLNAILMTSPRTIYENPTNIYSFAWTKKDIDQQNNIIINAITQIPAVKGIALGNQSRVIQGPGHTSGDLVYLKDSLELRCQYTGPQQSYDVRIRYASNGILNDRAMIAITIPGVTGQSISLSETFSGTDYNVLEFQNFKSVQFTSAIRLNPSQNIFIYLNRLDQNANTTLLIDKIEFIPHPLPRILSEQKLKKVKQKVNDLFIDAENGCFCPSHEKDLR

SEQ ID NO: 42 - protein, 681 aa, Artificial sequence
  variant of native sequence
LLIERGEIFMNQNNNEYEIADVNPPSYPSNRINNYSRYPFANDPNQLLQQTNYKDWLNICQGNNQNSGNLITDAGAAVSAGIIVTGTMIAAFAALAVAPFPIVGAIVGGIVIAFGTLLPLVWPGGKEDRTVWTQFFALGETLLGKRLTDDAQKTAAETVDGFGRVLDNYKVALNSWMDLKKKQSPGSPPTTELKEAADNVKQRFEIVHNEFDANMPHLGNPKSNYKEVLLSSYAHAANLHLNLLQQGVRFADQWNQDIYSSQIVPAAGTSTEYLKFLQARIQEYVNYCTATYRSGLNILKNSNDITWDIYNTYRRDMTLTVLDLVAAFPNYDPTYYPIDTKIQLTRTIYSNLLGITQSGRQYFEALENALTMRPNLYRILRGFNFNTTFGSGVNYLSGIANRRGLIKTVPSEEDEQPFYGQSNGRHDPMIFANGLNIFRVTLLRNKHYIALPVGPPLFAANQITDLKLYYGNATQYHHYQPSNEGLTTESTDLSFPPKNEEYLNAILMTSPRTIYENPTNIYSFAWTKKDIDQQNNIIINAITQIPAVKGIALGNQSRVIQGPGHTSGDLVYLKDSLELRCQYTGPQQSYDVRIRYASNGILNDRAMIAITIPGVTGQSISLSETFSGTDYNVLEFQNFKSVQFTSAIRLNPSQNIFIYLNRLDQNANTTLLIDKIEFIPH

SEQ ID NO: 43 - protein, 1229 aa, Unknown
  Bacillus sp. obtained from an environmental sample
MNQNNQKEIQIIGSSSNDVSQSNGYPRYPLAKESNYKNWLTSCDESNLDRFSTPSSVQDAIVTSLSVTSYIISFLEGPIGAGLGILSVLFGQFWPFNTNTVWDNLLRVVEELINQRINEVERERIIRQFDGIRSVLSNYNTAFRNWNENETTRNNPRLQEELRHRFNNTDDIIADRMPEFRIKGFETQSLAVYAKAATLHLLLLRDAVVYGRAWGFDSQTIESLYTKLVCLINAYADHCILVYSQGLQELRNRGNWRNFNNYRRDMTITVLDIISLFSNYDPRIYFYNTNTQLTREVYTEPIASGNWLNSYSNPDQFQQIENDLNPPPSLFSTLSTLFARIGFFYYNDIYTPRDAILNTSMRLTRTDGTTIITTPWQGALSPEISQERQLIFSGYKVYKVDSILSNTAVQFTGVQRADFHMVNEAGTGVTSRSIDLPLTTYYFSKASNIPGTRSETPTSLDYTHILSSVRSTSIGTTYRNRSNIIAYGWTHTSAERTNRILPNRITQIPAVKAFALESGASVRPGPGHTGGDVVSLALSGRLKIRLTPASTNTNYRVRIRYATSYGASLMVQRWSPSGSESGYFSSSHTGAYPKFGYMDTLVTNFNQTGVEIIIENRHYSNIIIDRIELIPVNSTALEYEGKQHLEKAKKAVGNLFNNNGKEALKIDTTDYDVDQAVNLVECVPEELYTKEKMILLDEVKHAKQLSASRNLIQNGNFEFYTDEWTTSNNVSIQADNPIFKGNYLKMPGARETEGGTTRFPTYVLQKIDESKLKPYTRYKVRGFVGGSHDVKLIVERYGNEVDAILNVRNDLALDTISPSCVEVNQCQSQMYPLMHDGYLANVINTNSYEESQLDRANFKKEQGMCHQSHQFDFHIDTGEVHINKNPGIWVLFKISSPEGHATLDNIELIEEGPLVGESLALVKKREKKWKNKMETRWFQTKEVYEKAKGAIDALFTDAQDQALKFDINISHIISAEHFVQSMPYVYNRWISDVPGMNYDIYTELDLRITQAYSLYEHRNIIKNGDFNHGLNHWHATPHAKVQRIDDTAVLVIPNWSSSVSQNLCVEYNRGYVLRVTAKKEDIGKGYVTISDCNGNQETLTFTSCDNYVSNEITNDQSEYPFSQEMNEQRSYNPNEAINGQLGYSLGQVRNEQSCYTRNAITNDQSEYHFSQEMNEQRSYNPNETINEQRNYVTRTIDFFPDTDKIRIDIGETEGTFNIESVELICMKSQ

SEQ ID NO: 44 - protein, 632 aa, Artificial sequence
  variant of native sequence
MNQNNQKEIQIIGSSSNDVSQSNGYPRYPLAKESNYKNWLTSCDESNLDRFSTPSSVQDAIVTSLSVTSYIISFLEGPIGAGLGILSVLFGQFWPFNTNTVWDNLLRVVEELINQRINEVERERIIRQFDGIRSVLSNYNTAFRNWNENETTRNNPRLQEELRHRFNNTDDIIADRMPEFRIKGFETQSLAVYAKAATLHLLLLRDAVVYGRAWGFDSQTIESLYTKLVCLINAYADHCILVYSQGLQELRNRGNWRNFNNYRRDMTITVLDIISLFSNYDPRIYFYNTNTQLTREVYTEPIASGNWLNSYSNPDQFQQIENDLNPPPSLFSTLSTLFARIGFFYYNDIYTPRDAILNTSMRLTRTDGTTIITTPWQGALSPEISQERQLIFSGYKVYKVDSILSNTAVQFTGVQRADFHMVNEAGTGVTSRSIDLPLTTYYFSKASNIPGTRSETPTSLDYTHILSSVRSTSIGTTYRNRSNIIAYGWTHTSAERTNRILPNRITQIPAVKAFALESGASVRPGPGHTGGDVVSLALSGRLKIRLTPASTNTNYRVRIRYATSYGASLMVQRWSPSGSESGYFSSSHTGAYPKFGYMDTLVTNFNQTGVEIIIENRHYSNIIIDRIELIPV

SEQ ID NO: 45 - protein, 825 aa, Unknown
  Bacillus sp. obtained from an environmental sample
LFSIFGIQMLSYIKIGGENMHQTNTSKDKNRMASFEKTNMSNEGPIYPLANSSNTGLQGMNYNDSVNMHATKNEDCLLSSRVSVDPKTAVATGIKISTFIMSALGIPLASQIGQLWNFVLDQLWPNGDNQWEEFMKHVEELINQKITEYARDKALAELEGLGNVLELYQEAIEDWKKDPTNVASQERVRTRFRNADAFFENGMPSFRIKNYEVPLLSVYASAANLHLLLLRDASIYGKDWGLNETNVKDNYNRQLKRTESYSNHCVTWYQKGLQRLKGSDADSWLKFNAFRRDMTFTVLDIVVLFPCYDIQKYPMGVKTEITREIYTDPIGNLPRRPGFQVLDWVNHAPSFEEIEKETTGDPSMVTWINYLEISRNKLGGWNSSNDYWEGHSVHYKYSNDGIVIDSKAYAHGDFSGKFPTEAIHLENCDVYASSSLPVAASNPYGDKASFGVTKVYFDMLNLNDNTLQRGSWDHPKNWGGSWVDLKFLNETPNIKEIQKYSHKLTYVSSFSVDYGSVLCYRWRHSSVDRNNTLDPQKITQISAVKGHTPINCEVVRGNGLTDGDWLQLKGGGSFTLNVSSVIPKTYRIRLRYACGPKDVNLTVSCPDNGIDKTITIPSTSTASLANNLMYKDFKYIDLPIEFITSAAPKRCRINLRLEGVQNTSFFMDKFEFIPENETETRPWKIVTALNNSSVLAFAKNSLYKEAILSNDTGEESQKWRFIYDEEKKAYQIEDVKSPRLILAWIIDGPESRKVWATRSQNIDEHYWILEEQEDSYFIIKNKKNPSLVLDVDGAQTNQGTKIKVNERHPLYSSRTNAQKFKLERV

SEQ ID NO: 46 - protein, 675 aa, Artificial sequence
  variant of native sequence
LFSIFGIQMLSYIKIGGENMHQTNTSKDKNRMASFEKTNMSNEGPIYPLANSSNTGLQGMNYNDSVNMHATKNEDCLLSSRVSVDPKTAVATGIKISTFIMSALGIPLASQIGQLWNFVLDQLWPNGDNQWEEFMKHVEELINQKITEYARDKALAELEGLGNVLELYQEAIEDWKKDPTNVASQERVRTRFRNADAFFENGMPSFRIKNYEVPLLSVYASAANLHLLLLRDASIYGKDWGLNETNVKDNYNRQLKRTESYSNHCVTWYQKGLQRLKGSDADSWLKFNAFRRDMTFTVLDIVVLFPCYDIQKYPMGVKTEITREIYTDPIGNLPRRPGFQVLDWVNHAPSFEEIEKETTGDPSMVTWINYLEISRNKLGGWNSSNDYWEGHSVHYKYSNDGIVIDSKAYAHGDFSGKFPTEAIHLENCDVYASSSLPVAASNPYGDKASFGVTKVYFDMLNLNDNTLQRGSWDHPKNWGGSWVDLKFLNETPNIKEIQKYSHKLTYVSSFSVDYGSVLCYRWRHSSVDRNNTLDPQKITQISAVKGHTPINCEVVRGNGLTDGDWLQLKGGGSFTLNVSSVIPKTYRIRLRYACGPKDVNLTVSCPDNGIDKTITIPSTSTASLANNLMYKDFKYIDLPIEFITSAAPKRCRINLRLEGVQNTSFFMDKFEFIPE

SEQ ID NO: 47 - protein, 624 aa, Unknown
  Bacillus sp. obtained from an environmental sample
LYIGKTSGEVKMLRTIQYKNASEIVYDQPLPYGGVVKIAGKIGLGVVKTVITSIIRRGRDNEIAGRILSDVYSVLWSNRKGYWNEMIEAVETLIQQDISENIKNNALAALTDIRNALLLYQQAVEDWESNRTDSQLQERVRNQLISTITFIEFAMPSFTVQHYEVILLPIFTQVANLHLLLLRDAEIFGLKWRMSKAEIDDYYFAKSGLTRLTQKYTNHSVKWYREGLCIATNIDLDQCPEFYQLDKWNAMNDFRREMTFMVLDIIALWPTYDPIRYPLGIKTELTREVFTPLLGINPNSSWLIRTMEEIEAKLTVLSPFLSWISFEQLVKQGDGISTFTDWGNFTLSNTMLPLSYILGGAGPGTGDSTNIPMQSENYDVYKVLVGTDYSHPSNVPIRKLEYYCTNGMMENVITVGTGTTNALFELPNNGCVDYSHRVSRLSCSNVEVYEWEGGPKYALKNIAYGWTHISVDSKNTLSHNAITQIPARKGYSSSESNLSIEGPYFTGGDLIALPPNGAQLQMRVSPPVSSSSINYCVRLRYASSGNTNIYVERVLSSGDTYGETHDVPATYSGGSLSYSSFAYVVNLTAIFEGFNVEIKIKNIGSSQIILDKIEFLPIKESLKE

SEQ ID NO: 48 - protein, 618 aa, Artificial sequence
  variant of native sequence
LYIGKTSGEVKMLRTIQYKNASEIVYDQPLPYGGVVKIAGKIGLGVVKTVITSIIRRGRDNEIAGRILSDVYSVLWSNRKGYWNEMIEAVETLIQQDISENIKNNALAALTDIRNALLLYQQAVEDWESNRTDSQLQERVRNQLISTITFIEFAMPSFTVQHYEVILLPIFTQVANLHLLLLRDAEIFGLKWRMSKAEIDDYYFAKSGLTRLTQKYTNHSVKWYREGLCIATNIDLDQCPEFYQLDKWNAMNDFRREMTFMVLDIIALWPTYDPIRYPLGIKTELTREVFTPLLGINPNSSWLIRTMEEIEAKLTVLSPFLSWISFEQLVKQGDGISTFTDWGNFTLSNTMLPLSYILGGAGPGTGDSTNIPMQSENYDVYKVLVGTDYSHPSNVPIRKLEYYCTNGMMENVITVGTGTTNALFELPNNGCVDYSHRVSRLSCSNVEVYEWEGGPKYALKNIAYGWTHISVDSKNTLSHNAITQIPARKGYSSSESNLSIEGPYFTGGDLIALPPNGAQLQMRVSPPVSSSSINYCVRLRYASSGNTNIYVERVLSSGDTYGETHDVPATYSGGSLSYSSFAYVVNLTAIFEGFNVEIKIKNIGSSQIILDKIEFLPI

SEQ ID NO: 49 - protein, 376 aa, Unknown
  Bacillus sp. obtained from an environmental sample
MMSNESKNNENMNLPIINDEDSIPSEIRDSRSKITFPDFNIYKIGTFCGKYVDIPGGANEDSSAIQFQTQDGDNQKFLIFTLDDSYSIIAARHSGKVMDAYYNSSQNRIIQFDFHNTNNQKFFLSDNGTIASKQDRQVWDVQGESTQNGARIVVFKFIDVRNQKFTLNKLGSVPVHQPTLSPLPSAPDFRTNDINEQLPDQTNPVNTHFTYLPYFMVKDPLYNAQQQIKNSPYYTLVRRQYWEKKTQRILAPSDTYEYSETIGVSRTDQSSMTDITEISIGVDLGFVFKGFSAGLSTNVTRTLSVTKSTSNTESSESTRKLSYKNEFRHTIAYAKYMLINEYYVTRANGEKITTGDATYWRVPNPEQTVARIIPRS

SEQ ID NO: 50 - protein, 665 aa, Unknown
  Bacillus sp. obtained from an environmental sample
VEATRRKYQICCHQTYTIYKGGLCMNKNNNEITEVPCSECGDIDYRDIMNMSTQGEYVAQQSVVLTAMNTSFQVIRTLYQANKGTLSKAGGVIKSIFTYLWRQKNSQEEWDNFMKAVEILIAEELSTYARNDAIASVRGLENVLNEYQEALDDLALDPTNSALKDEVKRWVTTVHGQFEATMPTLAVGGYEVQQLVAYAEAANLHLAFLRDVAKFGYQWDLDKTTVANYYKDLKENTQIYTDHCVRTYNTGLEKTKSLMGAINPKDYNKYPYLNPYANGSTNFYKKVLQWNVWNDFRRDMTIMVLDLVALWPTFDPEVYTNPEGVDLELSREVYSTAYGRYGSSTHGGDWKSWEVMETAVDRSPHLVSFLTNLAIYQKTYSSSSTNTKLDQYDGVINTLKTVGSTSTFEDGFAPISKEAYRSVKNIPGEYINGVDLRLGMVPCSLTFKTYSSGTFFAGQCYSHLAQSTFYNLSATIAYHRLSYVNAIDDNFSGYYSGWGIGTWGMGWLHENLKTLNIIHATKSSCIPAVKARILTNSATVIKGPGSTGGDLVKLPGVPSTSDIQVRMNMTREVWKNYRIRIRYATSSSAQLFVGKWTGRWAATANINLAATYSGELTYSAFKLADVPFNITTGEPEFSFELRNNSGGPILIDRIEFIPLEGTFAE

SEQ ID NO: 51 - protein, 659 aa, Artificial sequence
  variant of native sequence
VEATRRKYQICCHQTYTIYKGGLCMNKNNNEITEVPCSECGDIDYRDIMNMSTQGEYVAQQSVVLTAMNTSFQVIRTLYQANKGTLSKAGGVIKSIFTYLWRQKNSQEEWDNFMKAVEILIAEELSTYARNDAIASVRGLENVLNEYQEALDDLALDPTNSALKDEVKRWVTTVHGQFEATMPTLAVGGYEVQQLVAYAEAANLHLAFLRDVAKFGYQWDLDKTTVANYYKDLKENTQIYTDHCVRTYNTGLEKTKSLMGAINPKDYNKYPYLNPYANGSTNFYKKVLQWNVWNDFRRDMTIMVLDLVALWPTFDPEVYTNPEGVDLELSREVYSTAYGRYGSSTHGGDWKSWEVMETAVDRSPHLVSFLTNLAIYQKTYSSSSTNTKLDQYDGVINTLKTVGSTSTFEDGFAPISKEAYRSVKNIPGEYINGVDLRLGMVPCSLTFKTYSSGTFFAGQCYSHLAQSTFYNLSATIAYHRLSYVNAIDDNFSGYYSGWGIGTWGMGWLHENLKTLNIIHATKSSCIPAVKARILTNSATVIKGPGSTGGDLVKLPGVPSTSDIQVRMNMTREVWKNYRIRIRYATSSSAQLFVGKWTGRWAATANINLAATYSGELTYSAFKLADVPFNITTGEPEFSFELRNNSGGPILIDRIEFIPL

SEQ ID NO: 52 - protein, 383 aa, Unknown
  Bacillus sp. obtained from an environmental sample
MMQFNKRNGNNAEFYKGEKVTPFEYDLPEEGKAFQTIGSILSTNNRILVATRTRSGQELGQDVGDFCRRVTLNNQVVNDTAAATNYEAQFIFFKKDFSGYIIANRQHGEVLESVFANNDSLITAPYANKTQQVFGKSSYSDKSFRLYGDHGAITTCGDKWNSWTRITMSGSNENQARYVFKHGDTSFPITIPTKLEPTTLGPIPELTNLDDVGTPPAPAVVGTALLPCIFVNDRTPSQRIQDSPYYVLECYDYWKLIKSSIIQPGGFDNWWEETGIHSNVQAAMKNMINISIGDDKRLRFFNLSDPFHQSIVEDINIPASTSNSDLSFITAIREHTNPYSTRLRFAKYFVARKFELKRLDGSTPIYTWEYIDDTKYVMKEFRS

SEQ ID NO: 53 - protein, 862 aa, Unknown
  Bacillus sp. obtained from an environmental sample
MVFLPTITCISRRYFMAQLQELQIQPVIPYNVLASPPMGNVDDLPTLAEELKQAWESFQKTGNLNFTAFQQGLAAAGGGSFNYLALLQAAIGLAGTVGAEIPGVAIAAPLVSILLGFLWPNKQKSDIKQLITVIDAEVKRILNQELTDYHSQEVQGYLEGFFDTMTNPATSPDIKINESIFTGMPGDPNRTPKDVDATAYDAVVDRFLTANVSFIIDLDQFLTGKFGTNNDVNFDVASLPYYVIGATLQLMSYHSVINFMTAWFPKIWPQYTTEDSRYKDILNAKQAMRMAIRDNTNKVLTIVQANLPSLGSTRNSLNDYNRYARTMQLTCLDTVAQWPTLYPDDYPVSTTLEQTRRIFLDTAGIDERKDSNGKYTNDSTITALYNILDGNSYNSHNNVGINGINSLLYSQDELKSITYRMTYTNNNDYGQYPCFPYGVVLGYTNNQYPSNPAYGNGGDPNNGSYIDSPNTSAPFHTVDAATQNTMYIDAQNMFTDSNPTGCNILNYGGPNGGKSNNPTLATQKIDTLFPFTINNPPGSTKNGLGRLGVMASLVPYNLSPNNVFGEFDSDTQAIIAKGFPAEKGYIDNGSPVSVVKEWVNGANAVQLPAWNTFKITATNLAAGQYRIRVRYANPGPDLLLHQYVYAGDNEVQGGAWTFKSTTDSNVNTNFPNQVYVTGQQGNYVLEDITWPMGGGPSDPLTLPAGDVTVQLFLGDFSQQGQMTQVFIDRIEFVPVGATFPSTIPISVNAQYNQGSVLLWQAPSSSYFIYNFDITGTLYGSQFTSVFFDLENPQGSSGIVPGINQSITLNPNGTDISYKNLTANLNSHGGFNLMRMEGAGSEDFGSNITGNLTITIHKDSTNS

SEQ ID NO: 54 - protein, 735 aa, Artificial sequence
  variant of native sequence
MVFLPTITCISRRYFMAQLQELQIQPVIPYNVLASPPMGNVDDLPTLAEELKQAWESFQKTGNLNFTAFQQGLAAAGGGSFNYLALLQAAIGLAGTVGAEIPGVAIAAPLVSILLGFLWPNKQKSDIKQLITVIDAEVKRILNQELTDYHSQEVQGYLEGFFDTMTNPATSPDIKINESIFTGMPGDPNRTPKDVDATAYDAVVDRFLTANVSFIIDLDQFLTGKFGTNNDVNFDVASLPYYVIGATLQLMSYHSVINFMTAWFPKIWPQYTTEDSRYKDILNAKQAMRMAIRDNTNKVLTIVQANLPSLGSTRNSLNDYNRYARTMQLTCLDTVAQWPTLYPDDYPVSTTLEQTRRIFLDTAGIDERKDSNGKYTNDSTITALYNILDGNSYNSHNNVGINGINSLLYSQDELKSITYRMTYTNNNDYGQYPCFPYGVVLGYTNNQYPSNPAYGNGGDPNNGSYIDSPNTSAPFHTVDAATQNTMYIDAQNMFTDSNPTGCNILNYGGPNGGKSNNPTLATQKIDTLFPFTINNPPGSTKNGLGRLGVMASLVPYNLSPNNVFGEFDSDTQAIIAKGFPAEKGYIDNGSPVSVVKEWVNGANAVQLPAWNTFKITATNLAAGQYRIRVRYANPGPDLLLHQYVYAGDNEVQGGAWTFKSTTDSNVNTNFPNQVYVTGQQGNYVLEDITWPMGGGPSDPLTLPAGDVTVQLFLGDFSQQGQMTQVFIDRIEFVPV

SEQ ID NO: 55 - protein, 888 aa, Unknown
  Bacillus sp. obtained from an environmental sample
MATVSELYPVPYNVLAISPSRLSSNWDEFQDIFNGVKEAFGEFQKTGQLQKEAIQQGWNAYREGKIDYLALVKASLSIVGLIVPGGEAAVPFIGMFLDFVWPKLFGGASNDETTLLNVINDVVNQILDKRLSEQQLQTVNNVLNGFQTQMLDLNRKILSATFDATTQKPRTPSASDMINVYDEFNLEQGLIHNDLYEFILKDYEDITLPMYVIAITYIGKVMSYQAFIQFANQWIDTVYPDTTSGEGYTFKTNLDAAKTKMQDDIDTASQHVLTVFQDHMVPAGVNKLQHNLHNQYVNTMVLQCFDFVAMWPTLYPDVYPANTSLDLTRVLFSDIVGPDEVHDGNVTLYNIFDNPQGYTHGSINMEDILYLRKELEQVRIFQHESGTNCWAYGIGLKYAGDPNIYMYSPSSFDPSLTVPSTVQAPIIVVNASTQYTKGLLDKESIGILADNGDNAGTYCPLPGHDGVEGYGRSHNSPLANQKINALYPVTAEHVAGDQRKLGLIATHVPFDLVPQNIIGQTDTDETISVRGFPAEKGTIDNIGSLQLVPEHINGANAVKLNFQQILAIPITSVTSGYYFIRIRYASSSDITGYFHVQTPAGDSNRGAITFPNTQNMENTIDKMYVTGANGKYTLLTVTQAIKIPSGNSTIYIQNNSNADFFLDRIEVIPITASQLPAPSSANQFTLVGPYTVLPEPVGKDFVIWQTSQTCAYTPNSTLSFTILGSGEFQALDKNNNIIARRVENQNNQTTETWNLPQNVEKIRFVANDYVVLRNIMGKINCQEPIKPCTLGGQTLVDIDYNANGEQVLWSSTEPMGNCTVDIVLDSDFISSIATLQFQDNTGTVVRSIDFGPGEQNQTVSVASTTKIVLKPTTFGPISGHLKIQVVTN

SEQ ID NO: 56 - protein, 670 aa, Artificial sequence
  variant of native sequence
MATVSELYPVPYNVLAISPSRLSSNWDEFQDIFNGVKEAFGEFQKTGQLQKEAIQQGWNAYREGKIDYLALVKASLSIVGLIVPGGEAAVPFIGMFLDFVWPKLFGGASNDETTLLNVINDVVNQILDKRLSEQQLQTVNNVLNGFQTQMLDLNRKILSATFDATTQKPRTPSASDMINVYDEFNLEQGLIHNDLYEFILKDYEDITLPMYVIAITYIGKVMSYQAFIQFANQWIDTVYPDTTSGEGYTFKTNLDAAKTKMQDDIDTASQHVLTVFQDHMVPAGVNKLQHNLHNQYVNTMVLQCFDFVAMWPTLYPDVYPANTSLDLTRVLFSDIVGPDEVHDGNVTLYNIFDNPQGYTHGSINMEDILYLRKELEQVRIFQHESGTNCWAYGIGLKYAGDPNIYMYSPSSFDPSLTVPSTVQAPIIVVNASTQYTKGLLDKESIGILADNGDNAGTYCPLPGHDGVEGYGRSHNSPLANQKINALYPVTAEHVAGDQRKLGLIATHVPFDLVPQNIIGQTDTDETISVRGFPAEKGTIDNIGSLQLVPEHINGANAVKLNFQQILAIPITSVTSGYYFIRIRYASSSDITGYFHVQTPAGDSNRGAITFPNTQNMENTIDKMYVTGANGKYTLLTVTQAIKIPSGNSTIYIQNNSNADFFLDRIEVIPI

SEQ ID NO: 57 - protein, 830 aa, Unknown
  Bacillus sp. obtained from an environmental sample
MNSLQTLQAQPIIPYNVLANPLSGNADAQPGSLGDLIASLKEAWVEFQKTGSDKLLQSVLQNGFSAASGGSFNYLAVLQAVIGVLSTVLGAEIPGVAVAAPILSMVIGWIWPSKKKDETQQLINLIDAEIQKQLNQALSNQDKNDWTGYLNAIFQISHDAARAVVDAQFTGSEGDTNRQPRTPGVSDYENVYNHLLATTGSLIVALSQMINGNFDTLAIPFFVIGATVQLSTYQTFIQFANKWLPIVYPDYQTQGTAGYTQQQNLINAKSDMRAAIHDHTQKVFNAFKTGMPSLGSDKNSVNAYNRYVRGMVLNGLDMLATWPSMYPDDYPSQTELEQTRVIFSDLVGKDQTVNNAVTLINMVDKSGPDAWNQHSSIDINSISYTRRELQQVQFPIHDGNRGNTTNCYPYAVILNYPDNSYFYGDLYAPQFSGNPTFGGDNDILTALNARTQHTRYVDSESLQMNCYPYASNDCHILGYCTGGTCLAPSGCSDGYGKSCNETLPDQKINALYPFRMDLGHSGTPDKLGVMSSHVPFNLIPNNVFGAIDSDTNNIIGKGFPAEKGYWSNGGDRPIPSSNIAKEWVNGANAVKVEYGAFLAMKATNMKTGKYYIRVRYANPSNKDVNMWQEVWAGNQKLQGGGWTFKSTSDDNVADNFPKQVYVTGQQGDPLNLPSGEIMVKLSGQNSGDSIYVDRIEFIPISETENINYMITSTVPLLPSGQYVPSLSNYPTIWTADSGQQAISATLTFSGLNSTLFLLAKTNPGDDNDENNWDWMCPDGFLGSVLNGTYTFPINNHDSACAKKPFTAIKIGAELIPVSAGTITGSITHQR

SEQ ID NO: 58 - protein, 700 aa, Artificial sequence
  variant of native sequence
MNSLQTLQAQPIIPYNVLANPLSGNADAQPGSLGDLIASLKEAWVEFQKTGSDKLLQSVLQNGFSAASGGSFNYLAVLQAVIGVLSTVLGAEIPGVAVAAPILSMVIGWIWPSKKKDETQQLINLIDAEIQKQLNQALSNQDKNDWTGYLNAIFQISHDAARAVVDAQFTGSEGDTNRQPRTPGVSDYENVYNHLLATTGSLIVALSQMINGNFDTLAIPFFVIGATVQLSTYQTFIQFANKWLPIVYPDYQTQGTAGYTQQQNLINAKSDMRAAIHDHTQKVFNAFKTGMPSLGSDKNSVNAYNRYVRGMVLNGLDMLATWPSMYPDDYPSQTELEQTRVIFSDLVGKDQTVNNAVTLINMVDKSGPDAWNQHSSIDINSISYTRRELQQVQFPIHDGNRGNTTNCYPYAVILNYPDNSYFYGDLYAPQFSGNPTFGGDNDILTALNARTQHTRYVDSESLQMNCYPYASNDCHILGYCTGGTCLAPSGCSDGYGKSCNETLPDQKINALYPFRMDLGHSGTPDKLGVMSSHVPFNLIPNNVFGAIDSDTNNIIGKGFPAEKGYWSNGGDRPIPSSNIAKEWVNGANAVKVEYGAFLAMKATNMKTGKYYIRVRYANPSNKDVNMWQEVWAGNQKLQGGGWTFKSTSDDNVADNFPKQVYVTGQQGDPLNLPSGEIMVKLSGQNSGDSIYVDRIEFIPI

SEQ ID NO: 59 - protein, 962 aa, Unknown
  Bacillus sp. obtained from an environmental sample
MIMQMVTKAMTPKLGALPDFIDDFNGIFGFMGNITDVMSTIFGVDTGDSSIDDVLNNQELLQEMQAQMQQIQESIKDMTDKEIITQSIEEQILALTKDLSTSITTEFEKIGNILTTYLQAMSGMLKDIYSQTSVIDQKVDKLLAMMTFALKELDYIKDNVVLNSSIVEITPHVQKLVYVNKKFLSLTRGFLQGEDLSIDSMQEIQEWAKSILATEMNSFEFSVDTLHSIIIGDNLYKRSALKTFSDVLLDDADQYGNFGTPLAKFYTFFSSLATLQINAYLCLTFARKVLGLSEIDYQLIMQDRIEQQNQLFVNLIQDKNYSNVLEIKGVYPMPHNNEDGNSFSLQAKKGYALIGLEFFMDNGIYKAKAYQGKIGKNFSVYADTVEEIISDDLSKVFLNNTKDFEQSYKYPLFGELKGEPNTLITRIGFGTKYDESKERQAVAYIDADFSPYEPKSGSISTEGTQTFQIEETKNYTYCYDAWPIGIIGDLYMTPLKSLSLHVDGDSRKNLYMSGESYFSTILSREYNTNFILFPYTNNSSPIVENLIQNGDFEDGDKYWEVSGDTAVIAKGEGIYGSNAISIKNTGDAFEPALKQELNLKPYTKYKLTAYVKSKTNDSQAGLIAIKYTNYMIAFISKTFSTSYKQIELKFRTGADTQNFYVTFEKSNTGYLLLDNIKLHEIPQTDNLIDCGDFGGYDYTTKIDCQYYEPYLWELDGGGSISNGFEEGLFGTDCLKIIKSGGANQKVQLKANTNYILTAYVKVDDPTTTAHIGCGSNQVTCNSTSYTLVKVKFKTGDDPSTTESSVYCSNPNDSGTIWADNFVLCEVPNLIVNGDFEQMDLSSWSLSPSERGTIYIGIGKGISNSNAIVLQDHNGKISQKLPLKPITKYRLTAYVSVTGGGTAQIGYGDDSASCTSNKFQQISTDFTTGADPLQSDDVIYLSTDGCTYTIADNFELYELDQIE

SEQ ID NO: 60 - protein, 860 aa, Unknown
  Bacillus sp. obtained from an environmental sample
MKNKKKYMKPLAVGLLATNIIGFGTQTVAFAATDKAPTKEQAQKGSFNPTVLASMPSDTSELQEILEDAITNPNTQISPKLVKDLQDKGFDYLSIVKAATGGLVKKIPYAGSFLSPLVEFIFPGKKYLTKETVWGAIQDKVSNLIDEKLTENQVNELIASLTGIQDNLKKYQVAVGLVNGKEPPIDKSIQMNAETDRTKEDLRGYIDHLDSDLGKEVPKFAVKNYEAASIPYYVQIANIHLFLLRDAVTHADEWGLTAKEKNTYLSRLQSKIIEYSNTVYDSFNKGVAAAKNKDGNWDNVNKFVRTMTVYGLDFVALWPTFDPSRYDEPTKLQQTRQVYSDLIGNPEAGSNYDTLLPQIHSSIFAGYPGELKQFNVSQADRIDSIKEVFDWTGDGSQDYTQQLGNPNPSGYSVRNVTRDAPVIGLSAYKSWNNNWYNMFSLSYPGKEVDFQSRFRQALRDGYVTKTSAPSGQKVSNIKAAETGKGKGTISSMVAAYIPEEVHPENILAARSITGIPAEKYNSRSAVDNAIEYTNGSNAMVFTQNGSSITYNIQSPEKRKYKIRLRVATNSDTSVGISVNGNAQQMNIENTEAKATDRTGIKGVNGTYTVIEGPTVELQEGKNTITIDHKDANKLVLDRIEFEHQPVAPEHGNPGWQTIDGKKYLYGKDGKLEMNSFQMMDGKQVYLNDDGAMVKGWKTINREKYYFNKTGDGSGMEREGEVAIGWKTINGVKYYFNKTGDGSGMEREGILATGWKTINGVKYYFNKTGDGTGSDHEGEMEIGWKTIEGVKYYLDPQNGKLVTGWKTIEGVKYYFNRIGDGSGMTHEGEMAIGNMTIDGVKHYFNKTGDGTGYNYEGELEW

SEQ ID NO: 61 - protein, 830 aa, Artificial sequence
  variant of native sequence
MATDKAPTKEQAQKGSFNPTVLASMPSDTSELQEILEDAITNPNTQISPKLVKDLQDKGFDYLSIVKAATGGLVKKIPYAGSFLSPLVEFIFPGKKYLTKETVWGAIQDKVSNLIDEKLTENQVNELIASLTGIQDNLKKYQVAVGLVNGKEPPIDKSIQMNAETDRTKEDLRGYIDHLDSDLGKEVPKFAVKNYEAASIPYYVQIANIHLFLLRDAVTHADEWGLTAKEKNTYLSRLQSKIIEYSNTVYDSFNKGVAAAKNKDGNWDNVNKFVRTMTVYGLDFVALWPTFDPSRYDEPTKLQQTRQVYSDLIGNPEAGSNYDTLLPQIHSSIFAGYPGELKQFNVSQADRIDSIKEVFDWTGDGSQDYTQQLGNPNPSGYSVRNVTRDAPVIGLSAYKSWNNNWYNMFSLSYPGKEVDFQSRFRQALRDGYVTKTSAPSGQKVSNIKAAETGKGKGTISSMVAAYIPEEVHPENILAARSITGIPAEKYNSRSAVDNAIEYTNGSNAMVFTQNGSSITYNIQSPEKRKYKIRLRVATNSDTSVGISVNGNAQQMNIENTEAKATDRTGIKGVNGTYTVIEGPTVELQEGKNTITIDHKDANKLVLDRIEFEHQPVAPEHGNPGWQTIDGKKYLYGKDGKLEMNSFQMMDGKQVYLNDDGAMVKGWKTINREKYYFNKTGDGSGMEREGEVAIGWKTINGVKYYFNKTGDGSGMEREGILATGWKTINGVKYYFNKTGDGTGSDHEGEMEIGWKTIEGVKYYLDPQNGKLVTGWKTIEGVKYYFNRIGDGSGMTHEGEMAIGNMTIDGVKHYFNKTGDGTGYNYEGELEW

SEQ ID NO: 62 - protein, 644 aa, Artificial sequence
  variant of native sequence
MKNKKKYMKPLAVGLLATNIIGFGTQTVAFAATDKAPTKEQAQKGSFNPTVLASMPSDTSELQEILEDAITNPNTQISPKLVKDLQDKGFDYLSIVKAATGGLVKKIPYAGSFLSPLVEFIFPGKKYLTKETVWGAIQDKVSNLIDEKLTENQVNELIASLTGIQDNLKKYQVAVGLVNGKEPPIDKSIQMNAETDRTKEDLRGYIDHLDSDLGKEVPKFAVKNYEAASIPYYVQIANIHLFLLRDAVTHADEWGLTAKEKNTYLSRLQSKIIEYSNTVYDSFNKGVAAAKNKDGNWDNVNKFVRTMTVYGLDFVALWPTFDPSRYDEPTKLQQTRQVYSDLIGNPEAGSNYDTLLPQIHSSIFAGYPGELKQFNVSQADRIDSIKEVFDWTGDGSQDYTQQLGNPNPSGYSVRNVTRDAPVIGLSAYKSWNNNWYNMFSLSYPGKEVDFQSRFRQALRDGYVTKTSAPSGQKVSNIKAAETGKGKGTISSMVAAYIPEEVHPENILAARSITGIPAEKYNSRSAVDNAIEYTNGSNAMVFTQNGSSITYNIQSPEKRKYKIRLRVATNSDTSVGISVNGNAQQMNIENTEAKATDRTGIKGVNGTYTVIEGPTVELQEGKNTITIDHKDANKLVLDRIEFEHQ

SEQ ID NO: 63 - protein, 614 aa, Artificial sequence
  variant of native sequence
MATDKAPTKEQAQKGSFNPTVLASMPSDTSELQEILEDAITNPNTQISPKLVKDLQDKGFDYLSIVKAATGGLVKKIPYAGSFLSPLVEFIFPGKKYLTKETVWGAIQDKVSNLIDEKLTENQVNELIASLTGIQDNLKKYQVAVGLVNGKEPPIDKSIQMNAETDRTKEDLRGYIDHLDSDLGKEVPKFAVKNYEAASIPYYVQIANIHLFLLRDAVTHADEWGLTAKEKNTYLSRLQSKIIEYSNTVYDSFNKGVAAAKNKDGNWDNVNKFVRTMTVYGLDFVALWPTFDPSRYDEPTKLQQTRQVYSDLIGNPEAGSNYDTLLPQIHSSIFAGYPGELKQFNVSQADRIDSIKEVFDWTGDGSQDYTQQLGNPNPSGYSVRNVTRDAPVIGLSAYKSWNNNWYNMFSLSYPGKEVDFQSRFRQALRDGYVTKTSAPSGQKVSNIKAAETGKGKGTISSMVAAYIPEEVHPENILAARSITGIPAEKYNSRSAVDNAIEYTNGSNAMVFTQNGSSITYNIQSPEKRKYKIRLRVATNSDTSVGISVNGNAQQMNIENTEAKATDRTGIKGVNGTYTVIEGPTVELQEGKNTITIDHKDANKLVLDRIEFEHQ

SEQ ID NO: 64 - protein, 962 aa, Unknown
  Bacillus sp. obtained from an environmental sample
VIKMNNTIVPYNVLRDNDMSNISGTSWDKDQISKGMENSSILLELIEKGLNDGNDILSLLGFIGMKAIEAIPVVGGTISSLISLILFPLKSKVDYQEIWNQLKKSIEKMVDQKIEEAMMSQLMQEIAGLAAILEQYRAAYDLYNGKKVFNIPDGMTPGDHLNTVFVSANMQFIQRMKIFQNPKYKVDLLPFFVHAAEMHILLVRDAAIYGLEWGMDEAVNQYYKMELKRLINEYSKYVLDTYQKGLKEVTERELEDNDFPTTWQKDNYKNTVRWNVINKYKRGMSLTVFDFAYKWKYYHESYQKNLMLNPTRTIYSDIEGSVYPYTKETSEIDNDINFTNLEYRGILKEVQVNNADRIDSLQSIFIRENQKFENRKTGGSGGRGTFVNIESPKNNPLTRVETWSELVPFALKFGFYNGEETRLMGQKTYGKKYTIYQYSGNKVVSIMGFGLNATSGFDSLDAMVVGFKQDDYIPENKIVPINTNGEPLIQVVEVGNFYEGKFESNLKMIEEPMFGDGVLQFENHSNNLNQDNYVTYQIHAEIEGTYELNAIIGANKQKDRIAFKMSLNGEQPENFITESFDDGDIWEGMSLNEELVYKKNSLGNFQLNKGVNNITIYNGALQASANIKIWNLATIELTINADSLKDPDITTLYDQDNYTGTKKLIFEDTNRLEDFNDKASSIKAESHIAGIRFYQNYDYTGDFIDLVGGEKISLKNHLFNNRASSVKFANIVLYNKDNYEGSRKFVFEDIPELTDFNDQTSSIVISSNVSGARLYEHANYEGNYVDVVGGQRLSLKNHVLNKEITSIKFFKGDDEILNGIYQIVPAINNTSVIVNLESSAFVWLWGKDSEFAHQWRVEYDESELAYQIKNMSNENIVLAAMIVTEPSYAHGIPNMKNSLQYWIFEYVGNGYYIIKLKANPKLVLDVNGGNPNDGTIIKVNYSHDLNSPNINAQKFRFNNMNN

SEQ ID NO: 65 - protein, 1396 aa, Unknown
  Bacillus sp. obtained from an environmental sample
MGGLLMNQYYNNNEYEILDNGGRGYQPRYPLAQAPGSEFQQMNYKDWMDRYTGEEQAGGLIRAEIDANTALTATFGVAWAVLGVSNPVGSAIAGILNVVTPIIFNQVDPNSPLKVWESMIGYAQALIKKELTETVRNLALDHIDRINDYQIDYKNKARIWEGNPTPGNASQLLDAFKNLKKSCQDAMPHLDTRGYETILLPLYAQAANIHLIVLRDGLMHGRSWGMTNEEYEDLYSGFFGFKNRIATYTNYCTNTFNQGATTNYTADMEDCAKYPWVRYNQDEFYSGFFGPENSCRQSQTTNAYPQPKSGFNQPLNLRNSRQSPGEYRDVEAWNLRNEFISSMTIQVLDTVALWPTYDPRVYTSAVKTEFTREIYTSIRGTTYRSDPAQNTMSAIEARMIRPPHLFEWPQTMTFFFEDVNVRYTWVGNSWTKGQALIGLKTESARTLDTNMITALQGLTDEYEYYHIPLDVSTRQKDITNIRTKQWFEPREFIFYRSGGQQVLALGTIEEDIPGYSVYLVNDYIYTPSIRQNTFPPIEVPEGTPPPSHRLSWVKFEPVRDNATTFVDPKQIGATIFGWTHTSVDPNNTIDATKITQIPAVKASGGTDYQVIKGPGSTGGDLVSLPTYAKIEIPLTSSADQLYEVRIRYAAAEQKRIRIGKKSRDFQWRYIDYDVPSTPYSGGNLTYNAFSYKELGTVQGVLELSIERIDPFDEPIIIDKIEFIPIQGSVETYEADQDLEKARKAVNALFTSDAKNALQLEVTDYLVDQAAKLVECMSDEIYPQEKMCLLDQVKVAKRLSQARNLLHHGDFESPDWFGENGWKTSNHVSVTSGNPIFKGRYLNMPGADNPQLSDTVFPTYAYQKIDESKLKPYTRYMIRGFVGNSKDLEVFITRYDKEVHKNMNVPHDILPTDPCTGTYPLGEGPMLTNHTIPQDMSCDPCDAGTVMKVQQTLVKCEAPHAFTFHIDTGELNRDQNLGIWVGFKIGTTDGRATFDNLEVIEANPLTGEALARVKKREHKWKQKWMEKRTKIDKAVQIAQGAIQALFTDSNQNRLKPDITLNHILQVETEVQKIPYVYNAFLQGALPPVPGETYDIFQQLSSAVAIARSLYEQRNVLRNGDFMAGLSNWRGAKGAIVQKIGNASVLVISDWSANLSQDVPVNPGHGYILRVTAKKEGSGEGYVTISDGTEDNTETLKFTVGEVATRLAQSDMHSPMQGRYQERNMTNAPSEAYGTNGYTSHTMTNYPSDNDGTNAYPGNHNRNYQSESFGITPYGDETSMMNGPSNKYEMNAYAGSTYMTNNGVGCSCGCSTNAYAGENMMRNDSSNENGVGYGCGCRTHPNNRTDSYPMTAHGSSLSGYVTKTFEIFPETNRVCIEIGETSGTFKVESIELIRMDCE

SEQ ID NO: 66 - protein, 725 aa, Artificial sequence
  variant of native sequence
MGGLLMNQYYNNNEYEILDNGGRGYQPRYPLAQAPGSEFQQMNYKDWMDRYTGEEQAGGLIRAEIDANTALTATFGVAWAVLGVSNPVGSAIAGILNVVTPIIFNQVDPNSPLKVWESMIGYAQALIKKELTETVRNLALDHIDRINDYQIDYKNKARIWEGNPTPGNASQLLDAFKNLKKSCQDAMPHLDTRGYETILLPLYAQAANIHLIVLRDGLMHGRSWGMTNEEYEDLYSGFFGFKNRIATYTNYCTNTFNQGATTNYTADMEDCAKYPWVRYNQDEFYSGFFGPENSCRQSQTTNAYPQPKSGFNQPLNLRNSRQSPGEYRDVEAWNLRNEFISSMTIQVLDTVALWPTYDPRVYTSAVKTEFTREIYTSIRGTTYRSDPAQNTMSAIEARMIRPPHLFEWPQTMTFFFEDVNVRYTWVGNSWTKGQALIGLKTESARTLDTNMITALQGLTDEYEYYHIPLDVSTRQKDITNIRTKQWFEPREFIFYRSGGQQVLALGTIEEDIPGYSVYLVNDYIYTPSIRQNTFPPIEVPEGTPPPSHRLSWVKFEPVRDNATTFVDPKQIGATIFGWTHTSVDPNNTIDATKITQIPAVKASGGTDYQVIKGPGSTGGDLVSLPTYAKIEIPLTSSADQLYEVRIRYAAAEQKRIRIGKKSRDFQWRYIDYDVPSTPYSGGNLTYNAFSYKELGTVQGVLELSIERIDPFDEPIIIDKIEFIPI

SEQ ID NO: 67 - protein, 131 aa, Unknown
  Bacillus sp. obtained from an environmental sample
MIPTRIHNSMLSANDDLSFHSFQTCFLVRGAQAEEVKGLKPGQYGKYGREYEMVQTGRHHPDLFEGAMQSAATIDDPEQVQSSVSFCSMVHVPQGFVYVPKGTRKFAYSLPNLSVVKDTCQKTIAAQSMSR

SEQ ID NO: 68 - protein, 875 aa, Unknown
  Bacillus sp. obtained from an environmental sample
MSLLIKKERNVMPNEMNSKNNMNTTRIDDKDLLDSKGRECQPRYPSAEAPDVMNPIEKIYTRGQSANISNATSTTIDVTSQILRGSKKLAGLIIKVLIKILWPKGTQQEWENFMDAVEQLIHEKLDTYARNKATADLEGLQRVLSEYIDKLTIYTDDPNAAHAQSLRTQVITTDNLFEYSMPSFAIRDYEMQLLTVYAQAANLHLAFLEDIVRFGDEWGFTPAEIADFHKSMKERTDEYTNHCVSTYNKGLEKAKLLTADLCNHSTYPWTRYNQGWRKEETPNCSLQQIDSCEQPLNESDEQGTPYMGPERRSIDEYQKLENWNLYNAYRRDMTLMVLDIVSLWPTYDPKLYPTSYGVTSELTRELYTDIRGTTYRSDESQNSLDAIEGRMIPQPSLFRWLFGISIKMNQFIGTGGSDDWTSGNLMLGMRIMWRKTLTEQWEGLYFGGGGNLYINLNPLDYAEGITHVNTRQWFEPRWFEFYSGGYDTELKFQNKCGTIEEKSPFWAAGPYNYIYQPGVRTSQIPEHRLSWMTYEPVRENAPFVYPQYKQLGAVALGWTSNSVDQKNAIDLDKITSLPAVKGNEIRGPGSVVRGPGSTGGNLVLLNPTGEVSITVSQPILNKPGAGYYHVRIRYAAIANGKLNVKRSVNSSTQESVTYDYKQTTARDLTYSSFQYLEVYDFNPVTTASQFEVLLTNESGGPIYIDKIEFIPFQGTTGPEAPGIPADIYYTISPAIDENYYTIGGSTIWLSLKESFSNPPRDGQWRFVYDTNKKAYQIGTQLNEDPAGGLFAVLTSTEPNNNLTMYPNLSLDQQYWFVKDAGDGYVTLENYGYPGYVVNVPRVYQGAILTLSPFIGSMNHKFKLTKLSTNDEVILG

SEQ ID NO: 69 - protein, 712 aa, Artificial sequence
  variant of native sequence
MSLLIKKERNVMPNEMNSKNNMNTTRIDDKDLLDSKGRECQPRYPSAEAPDVMNPIEKIYTRGQSANISNATSTTIDVTSQILRGSKKLAGLIIKVLIKILWPKGTQQEWENFMDAVEQLIHEKLDTYARNKATADLEGLQRVLSEYIDKLTIYTDDPNAAHAQSLRTQVITTDNLFEYSMPSFAIRDYEMQLLTVYAQAANLHLAFLEDIVRFGDEWGFTPAEIADFHKSMKERTDEYTNHCVSTYNKGLEKAKLLTADLCNHSTYPWTRYNQGWRKEETPNCSLQQIDSCEQPLNESDEQGTPYMGPERRSIDEYQKLENWNLYNAYRRDMTLMVLDIVSLWPTYDPKLYPTSYGVTSELTRELYTDIRGTTYRSDESQNSLDAIEGRMIPQPSLFRWLFGISIKMNQFIGTGGSDDWTSGNLMLGMRIMWRKTLTEQWEGLYFGGGGNLYINLNPLDYAEGITHVNTRQWFEPRWFEFYSGGYDTELKFQNKCGTIEEKSPFWAAGPYNYIYQPGVRTSQIPEHRLSWMTYEPVRENAPFVYPQYKQLGAVALGWTSNSVDQKNAIDLDKITSLPAVKGNEIRGPGSVVRGPGSTGGNLVLLNPTGEVSITVSQPILNKPGAGYYHVRIRYAAIANGKLNVKRSVNSSTQESVTYDYKQTTARDLTYSSFQYLEVYDFNPVTTASQFEVLLTNESGGPIYIDKIEFIPF

SEQ ID NO: 70 - protein, 1018 aa, Unknown
  Bacillus sp. obtained from an environmental sample
MNQNYNDEYEIMNTGVMGYQSRYPLAKTPGSEIQQMNYKDWMDMYTHGESGETFISARDGVIIGTGIGWAILGFVPVLGPGLSAISGILNVLLPILWPEDAVTAESQVSWDKLMRTAEEIANKAIDAQVRAEAITELQGIQEAIQLYHGAVCDWKKAPTNVRLQETVRTQFIATNTVIFNRMPSFRVQGFETSLLSTYAQAANLHLAFLRDGVQFGTEWGLDPTTVDRYYGYLTANTASYTNYCVRWYDKGLSDLRTTNNWNKYNNFRRDMTIMAMDLVSLWPTYDPKRYPTFTKSQLTRTVYTPWIGHIKNRWMGHPQEVPFSEIESNLIDIPRLFAWLRELIVYSVDPQRRGYSTLVCGRKQRFQNTLSNNLWDRGMKGSHGEEPPQTLTIPSPQSKDDIWKINTTSTLMAQGPENTQIKGWDFSFTNSQTQTISTIYQGQESLVYAVSGLPCRSSYNLCDPCDPDCKVDILTPGDPCNDKLLYSHRFAYLGAGIDPYMGYPGRAGGYGYYSYGWTHISADANNLIDTEKITQIPAVKASGGTDYQVIRGPGSTGGDLVSLATDARIELKLTASIAKYYQMRIRYASPVQTRLRLETYQDDISGGPVNYDIPSTPYSGNQNELSYNAFGYKHVMNVYISLTGTKISIQRVDPFDYPFIIDKIEFIPIEGSLEAYQADQDLEKARKKVNALFMSDAKDVLKLNVTDYALDQAANLVECLSDEFCAQEKMILLDQVKFAKRLSQSRNLLNYGDFESPYWSGENGWKTSPHIHVASGNPIFKGHYLHMPGANQPQTSGTVYPTYIYQKVDESKLKPYTRYHVRGFVGNSKDLELLVERYGKEIHVEMDVPNDIRYTLPMNECGGFERCSHEPHHTCTCKDTARVDTGCQCQDKMNRMTTGVYTNIPTASEMYPNGYLVHKSCGCKDPHVFSFHIDTGCVDLKENLGLLFAFKISSTDGVANVDNLEIIEGQPLTGEALARVKKREHKWKETMKQKRCKTDEAVQAVQTAINALFTNAQY

SEQ ID NO: 71 - protein, 669 aa, Artificial sequence
  variant of native sequence
MNQNYNDEYEIMNTGVMGYQSRYPLAKTPGSEIQQMNYKDWMDMYTHGESGETFISARDGVIIGTGIGWAILGFVPVLGPGLSAISGILNVLLPILWPEDAVTAESQVSWDKLMRTAEEIANKAIDAQVRAEAITELQGIQEAIQLYHGAVCDWKKAPTNVRLQETVRTQFIATNTVIFNRMPSFRVQGFETSLLSTYAQAANLHLAFLRDGVQFGTEWGLDPTTVDRYYGYLTANTASYTNYCVRWYDKGLSDLRTTNNWNKYNNFRRDMTIMAMDLVSLWPTYDPKRYPTFTKSQLTRTVYTPWIGHIKNRWMGHPQEVPFSEIESNLIDIPRLFAWLRELIVYSVDPQRRGYSTLVCGRKQRFQNTLSNNLWDRGMKGSHGEEPPQTLTIPSPQSKDDIWKINTTSTLMAQGPENTQIKGWDFSFTNSQTQTISTIYQGQESLVYAVSGLPCRSSYNLCDPCDPDCKVDILTPGDPCNDKLLYSHRFAYLGAGIDPYMGYPGRAGGYGYYSYGWTHISADANNLIDTEKITQIPAVKASGGTDYQVIRGPGSTGGDLVSLATDARIELKLTASIAKYYQMRIRYASPVQTRLRLETYQDDISGGPVNYDIPSTPYSGNQNELSYNAFGYKHVMNVYISLTGTKISIQRVDPFDYPFIIDKIEFIPI

SEQ ID NO: 72 - protein, 662 aa, Unknown
  Bacillus sp. obtained from an environmental sample
MGGLLMNQYYNNNEYEILDNGVQCCSPRYPLAQAPGSEWQNMNYQDVMNTSVGREYQAVQQVNVGEAVGAALGILTTILKAVNPTLGTAAGVISSIFGFLWKRFGTDPQAQWKQFMEAVEYLVSQKITDAVRSKAVSELEGVQRAVELYQEAANAWNMNPDNAAAKERIRRQYTSTNTVIEYAMPSFRVGSFEVPLLTVYAQAANLHLLLLRDAVKFGAGWGFSPTEVEDNYTRLQARTAEYTNHCTNTYDKGLKQAYDLAPNPTDYNKYPYLNPYSKDPIYGKYYTAPVDWNLFNDFRRDMTLMVLDIVAVWPTYNPRLYNNPNGVQIQLSREVYSTVYGRGWSNNSTVDAIESTLVRPPHLVTELTKLTFDERNLYEAETVPVAFRKVTNTLHYVGSSTTWEQSFSATPVGSLKAVHNVLATDIGNLALSLGAVPLGFSFYNKNDQHITTVGYSGGWWNGIPKDEGSNQNSHHLSYVAALETQTTAGWFPTYPVPLLGEWGFGWQHNSLKYTNRLVTNQINQLPAVKASALVNHARVSKGTTGTGGNIIELVNPNCGFIFNFYAEPENPQGQAFNIRIRYSATVPGKLNIRHLESGKEFMNTPRDFKGTTTGTNWIPKFQEYQYLDLGPIVLRTGMNYGFKIELASGQLVSIDKIEFLPF

SEQ ID NO: 73 - protein, 197 aa, Unknown
  Bacillus sp. obtained from an environmental sample
VKRLKPGQYGKYGREYEMVQAGSQHPPLFEGAMQSAATIDDREQVQSSVSFCSMVHVPQGFVYVPKGTRKFAYSLSGISIVKEASQKTITVDNCGPVDVTLNLLKVVGSIPYLVNAQVQGECGEKYGAAQGRDNQIELSHTGHIPVNTVLKFSVASLPDYQIEEKNIVISAFDVTPVQEQDNQFLQFIGTLTFQNIP

SEQ ID NO: 74 - protein, 731 aa, Unknown
  Bacillus sp. obtained from an environmental sample
MEAGYSQEGRRFAFHDISLIQWKHICYKNQKPKSPRRNEILAIYCVCFMDVTLMQKGGFFMNQYVTRAREAVNALFLNNTLQAKVTDYQIDQAAKLVECIPDEIYPKEKMCLLDQVKVAKRLSQARNLLNYGDFESSDWSGVDGWNISAHVYAVADNPTFKGQYLNLPSANNPQFSDKIFPSYAYQKIDESKLKPYTRYMVRGFVGTSKDLELLVARYDKEVHKKMNVPNDIIPTDPCTGGYLLEQGSYPVLTNQMMPQNMSCDPCDTGYRNEVGMMVPNTNMMCQDPHAFQFHIDIGELDMDRNLGIWVGFKIGTTDGMATLDNVEVVEVGPLTGEALVRMQKREPKWKQKWAEKRMKIEKAVQAARDAIQALFTSPDQNRLQSAITLHTILHAEKLVQKIPYIYNQFLLGALPSVPGEQYDIFRKLSDAVAIAQSLYGQRNVLNNGDFSAGLSGWNATDGADVQQIGNTSVLVISDWSASLSQHVCVKPEHSYLLRVTAKKEGSGEGYVTISDGTEENTETLRFTVGEEATSSPLSDIRSTLRERYNEQNVPNASEEAYGINGYASNNMTNYPSDNYGVNAYPGVNNNMTNYQSESFGITPYGDENSMMNYPSNNYEMNAYPGSTNMTNPNGGCSCGCSTNAYAGENMRRNDASNENGFGYGCGCRTHTNNRTDSYAPPMIAQNSSSLSGYVTKTVEIFPETNRVCVEIGETSGTFMVESIELIRMDCE

SEQ ID NO: 75 - protein, 1060 aa, Unknown
  Bacillus sp. obtained from an environmental sample
MPISKEPILYPLVSSTSNIPTSESFTFDWNWGLHQALSIGTGLMKFIPGLGVVAGPYGALLNYVYGGVIDELFPKKDAGGQDTVDPTVLFQTFMAAAEQMIDEKLNDTVKSTAVTKLAGLKNNLTDLKTKLDTLKDNSDPKDTDELKKQVRDKFEAVHGLFRSDMPQFRVASYESILLPVYAQAANLHLIFLREAIIKGVSEWGFPQATIDKFYDNPTDKNGFKQLMEEYTTNCMSAYQQGLDKLATQSIDLCTSDQSYWNPAYYNQYLFLDDLFSYATCQHSLGDMSYGCGGGELKPICKNYNSRIYSKYMQSITNWNQYNDYVMSMQVTALDLVAMWPYWDPKVYPNGAKKELTREIYTDILGSPDGQTKGVTTISQELLPQPRLFTQLTQLDLNTEPHTIQQVTRNPVSGKVNATYKYLDGDIIVGITQHLQTTLGESKLHAQGSGGSKTQSYDNSYTNDFTMPLKVASWFEPRTIGFAKSSGEIYPVGTIGDETPFVEISKSIGHNSGTITAIAHHAVKISESTQSGYYEEYQGDTAYSIDEHRLSWMNYTPTSASSFVVTGKQIGSLSLGWTSSTVDPTNKVQKDTITSIPAVKSHSITDWGTGTVVKGPGHTGGDLVKLPSNTRAKMIVTIEDTSTSYDVRIRYAAPSGGHIQFSYWNGGSDVKVADTQLQNTGGNTNFEHFQYAMLTTDNAKFKAPFSPVEILIENIGDSDVYLDKVEFLVLSQPLSEQLPPGATPLTSQYMNPYGYNILWQSKNGEAANQGMVTFSQNDSAIKTFYLYNTEVVHQTTGSPSSWNGKFDTLYVQSPTSINLTQGFIVIDTTKNNPEPPIALPNQDILRPFTNEHEIWNGRYSTKALNLSLSTSSGAEGKIKFYNNTNLVHESPALSGSPSEPYTWEGSFNRITVYQSNSSDSNYFNLFGGFLKLDPNSNDNGNNGGPHNDCENIAHPDQPLYYESNNLIWTAAPNKLAYSTTEMQFVLSGGLGFTPGAIGAKIKLNFWKNDSIQYVAYGAVANLDFISAPAQSIPGGFDKITMDNDEYSFPTSLRMTLGSVCY

SEQ ID NO: 76 - protein, 729 aa, Artificial sequence
  variant of native sequence
MPISKEPILYPLVSSTSNIPTSESFTFDWNWGLHQALSIGTGLMKFIPGLGVVAGPYGALLNYVYGGVIDELFPKKDAGGQDTVDPTVLFQTFMAAAEQMIDEKLNDTVKSTAVTKLAGLKNNLTDLKTKLDTLKDNSDPKDTDELKKQVRDKFEAVHGLFRSDMPQFRVASYESILLPVYAQAANLHLIFLREAIIKGVSEWGFPQATIDKFYDNPTDKNGFKQLMEEYTTNCMSAYQQGLDKLATQSIDLCTSDQSYWNPAYYNQYLFLDDLFSYATCQHSLGDMSYGCGGGELKPICKNYNSRIYSKYMQSITNWNQYNDYVMSMQVTALDLVAMWPYWDPKVYPNGAKKELTREIYTDILGSPDGQTKGVTTISQELLPQPRLFTQLTQLDLNTEPHTIQQVTRNPVSGKVNATYKYLDGDIIVGITQHLQTTLGESKLHAQGSGGSKTQSYDNSYTNDFTMPLKVASWFEPRTIGFAKSSGEIYPVGTIGDETPFVEISKSIGHNSGTITAIAHHAVKISESTQSGYYEEYQGDTAYSIDEHRLSWMNYTPTSASSFVVTGKQIGSLSLGWTSSTVDPTNKVQKDTITSIPAVKSHSITDWGTGTVVKGPGHTGGDLVKLPSNTRAKMIVTIEDTSTSYDVRIRYAAPSGGHIQFSYWNGGSDVKVADTQLQNTGGNTNFEHFQYAMLTTDNAKFKAPFSPVEILIENIGDSDVYLDKVEFLVL

SEQ ID NO: 77 - protein, 522 aa, Unknown
  Bacillus sp. obtained from an environmental sample
MLLTQKGGHVMAISRIINPIFTKQEHLDQITNLVNNLFSSGSSSLSQSVSDYWIDQVLLKVNALSDTVFPTQKEQLRQRLAQAKQISKARNLLVGGNFETLNKWKLSRNAVLVAGHDLFQGYHLELPPAIDSVKYPSYAYQKIDESKLKANTRYYVSAFIAQGSQLEIMVSRYGQEYSQILYVPAEMAKPISPDGGPNCCFPHPCNCTACNEEEVDSHFFQVPIDVGTLQSSQNLGIEIGFKVASTDGFAKLSNIEVFEGRPLTAAEQRKVSRLENEWKEEQQTKETERTQLLQQIQQRFNMLYTTPEHHTLRAETGYQHLLETMLPSLHHVYHWFMPDVPDSDYALYYELQQKLERGWDQYFSRNLLENGDFLEPLDDSWYTQGNVSLHIINNNTMLRLHHWDSLIRKNASLPVVNEDAEYVIRVIGKGTGSVLIQNGTTTNKLVFTNSRQMETKEFHLQPEKEQLSLTIRSDANEFLVDAIEVILMNDGAEEEEQLPGMFPPINSNMGSTPNSNMMNNNQ

SEQ ID NO: 78 - protein, 804 aa, Unknown
  Bacillus sp. obtained from an environmental sample
MNQNYNNNEYEIIDNGNMGYQPRYPLARAPGSECPKPNAKDGLYTPLGRVDTVLQNLDIGLSIRTALGILQMILAARSPALGRAAGLINLIFGFLWGTLGGQKTWESFMKAVEALVDQKITDAVRAKALSELEGVQNAVILYQEAADDWNENPNDESNKERVRRQFTSTNTVMEFAIPSFRALGFEVPLLTVYAQATNLHLQLLRDAVKFGTEWGMPSAEVEDLYTRLTRRTAEYTDHCVTTYDKGLKQAYDLAPNPTDYNKYPYLNPYSKDPIYGKYYTAPVDWNLFNDYRRNMTLMVLDIVAVWPTYNPRIYTNPNGTQIELSREVYSTVYGRGGSNNSSVDAIESQIVRPPHLVTELTTLKIEQGSTLDMEQIQYPKYMKVTNTLHYIGSSSTWEQSSSAPPIRPITKIHTIPANNIGNLSLSQLDVPYRFSFYNKDDTLIAEVGAEFPPNTVTWNGIEKAEDSNQNSHRLSYVGALGTQSSAGFPWTYPTELLGEWGFGWLHNSLTPENRVGVTTITQIPAVKAYWMEQGAQVVKGPGSTGGDVIQLPVNGIIRINLTSINPQRNYSVRVRYAATANGRLNFSRIDSFGTIQSTSTEYVTTGAGANASSFTYNQFQYVDIDPSDSTQVYTGIILVNEMGGPIYIDKIEFIPLSQIIEPPQLIPDGSYQIITALNNRSAVQAIFKNVYPRLNNLELWEGSSFKWNFVYNAGRDAYQIFTADGGALTRFNEISTDRDPVFVRQNLSTDNQFWKIYYQNDGYFVIRNLDSALDVWGYSTANGTTVDAYRYHGGINQKFRLLKV

SEQ ID NO: 79 - protein, 656 aa, Artificial sequence
  variant of native sequence
MNQNYNNNEYEIIDNGNMGYQPRYPLARAPGSECPKPNAKDGLYTPLGRVDTVLQNLDIGLSIRTALGILQMILAARSPALGRAAGLINLIFGFLWGTLGGQKTWESFMKAVEALVDQKITDAVRAKALSELEGVQNAVILYQEAADDWNENPNDESNKERVRRQFTSTNTVMEFAIPSFRALGFEVPLLTVYAQATNLHLQLLRDAVKFGTEWGMPSAEVEDLYTRLTRRTAEYTDHCVTTYDKGLKQAYDLAPNPTDYNKYPYLNPYSKDPIYGKYYTAPVDWNLFNDYRRNMTLMVLDIVAVWPTYNPRIYTNPNGTQIELSREVYSTVYGRGGSNNSSVDAIESQIVRPPHLVTELTTLKIEQGSTLDMEQIQYPKYMKVTNTLHYIGSSSTWEQSSSAPPIRPITKIHTIPANNIGNLSLSQLDVPYRFSFYNKDDTLIAEVGAEFPPNTVTWNGIEKAEDSNQNSHRLSYVGALGTQSSAGFPWTYPTELLGEWGFGWLHNSLTPENRVGVTTITQIPAVKAYWMEQGAQVVKGPGSTGGDVIQLPVNGIIRINLTSINPQRNYSVRVRYAATANGRLNFSRIDSFGTIQSTSTEYVTTGAGANASSFTYNQFQYVDIDPSDSTQVYTGIILVNEMGGPIYIDKIEFIPL

SEQ ID NO: 80 - protein, 614 aa, Unknown
  Bacillus sp. obtained from an environmental sample
MNKDITRARETVQSLFANDTRNALKLSITDYAVDQAANLVECVSEDFHAQEKMILLDQVKFAKRLSQARNLLNYGDFESSDWSGENGWRTSPHVHVKSNNPIFKGHYLHIPGAMSPQFSNNTYSTYVYQKVDESKLKSYTRYLVRGFVGNSKDLQLLVERYGKEVHVEMDVPDDMQYTLPMNECGGFDRCKPTSYQTRNPHTCTCKDTAYTDTDCQCKDKMNRLTTGVYTNMPVDSSMYADGYHTHTSCGCGNKNMYQNGKHTHTSCGCKNPHVFSFHIDTGYVDLEENVGLLFALKIVSTNGVANIDNLEIIEGKPLTGEALARVKKREHKWKEKMKQKRCKTEEAVQAAQTAIQALFTNAEYNRLKFETLFPHILYADELVQGIPYLYHPFFKGALPPVPGMNDKLFQQLSDLVGRARGFYEMRNLVQNGTFSSGTGNWHVTDGVTTQPEGNTSVLVLREWSDQVIQHLRIDADRGYVLRVTARKEGGGKGTVTMSDCAAYTETLTFTSCDYNTLGSQTMTSGTLSGFVTKTLEIFPDTDRIRIDIGATEGVFKVESVELICMEQMEDRMYDMAGNVEEEMQYLQESGSVRNTSGPDCNTIPDFLGGPCPSP

SEQ ID NO: 81 - protein, 382 aa, Unknown
  Bacillus sp. obtained from an environmental sample
MVNIDKDKFYKIENIKYNKVLAISAGNTDNAFIYTDLGSDDQRWAFFKLDDESYRIVNKSNGKTLAMTNDDVFVYPHLVTADQHWTKYDIAENMKFRNLNNYKVLAAGPSSDVFVWDDLPSDVLDQQWKISPVENLVMPNLPTNFKKLGPSPTYSSPNDQFQEDMPRVLVGAVLVPYFAVADNNIDPGTQVKRNPYYVMEHYQNWHLLSENSLPAGGEETLTLHTGIRTIDQQTITQKSGISIASDAGFTFPIVPAGRADGPFPTVTGDLKTTITEELDVSISHTTELMKEVTQTQTVRNPFNQQLQYAKFAVKDTYILRRADNSVVYEVSAVDTTSIKGASYPEDKQPITDAAKIVASRYDVTNPNQTNCQCQVTCNCPSK

SEQ ID NO: 82 - protein, 1209 aa, Unknown
  Bacillus sp. obtained from an environmental sample
MYNIEIQIRTGGTFMNHNNNNNEYEIIDSHTSSYPSNRNSNHSRYPYTNNPNQPLSNTNYKDWLTMCQGNQPYRDKPQTLVDTGVAISTGLIIIGTIMTGFPALTPWGIGIVSFGTLLPVLWPSGETDKKVWIDFMNYGGTIFKPLLNEQKDQAQRILQGFHLPINSYQNGITTWQNLRKSHIPGTPPSSALREAARVARTRIDIANSALSRISEIQSAQFGAAILPFYAQAATLHLNLLSQAVQFADQLKADAENQPTQDAGTSDEYHRLLKQYTQQYTDYCVKTYQEGLTTLKNAPDMTWNIYNTYRRDMTLLVLDYIALFPNFDIRQYPTGTHSELTREIYTDALIKEQPNPPIPIPVAQRETELTRPPHLFSRLNRLLLFSNTDPSPPALSAVQNSFTYTNNNIVQYSQIYRLINSPEPTGSTQQIIISNTDIYRIELTLRQNYFITHNINFYTLDGITRRYNSGSTPETPIIINFQLPEFPADKIPPYGLGTKYSHILSYMKISPNRHNIVLPNERHLSFAWTHTSVNFDNEISNQIVTQIPAVKARSLDTSSSVISGPGHTGGDLVLFRSRMEFQCFVPTQTKYKIRMRYVAYSPNNSISLTLNIMGQVNYGLRALNIKSTVASEKDTVNPKYNDFQYLYFYTQDPNEIAIVNLYSLTNMTLQSNNFAGNTLVIDKIEFLPVTQTLEENLETQKLEEIQQTVNTFFTNHTKNILNIETTDYEIDQTAILVESLSEEQYPQEKMILLDTMKQAKQFSQSRNLLQNGDFSSFIGWTINNDLTLQTNNPIFKGQYLHILGARTTEIDNTIFPTYVYQKIDESKLKPYTRYVVRGCISNSKDLELFVTRYNKEIHKILNIPNDSSHMNAEIQTNSYEAQSYSFRNENNNLTNQQSPYPTTSNHSGYSESTLISSNFENENAFSFSIDTGNLDFNENLGIGILFKISNPDGYAALGNLEVIEEQPLTEEEVNRVTEKENRWKQVRNNQQKETEQAYYQAQQAIDALFINSQHQMLKIETTIQDIVVAETFIDKIPYIYNEWLPNEPGMNYTLYQGLKQQISQAYMLYRNRNLIQNGNFINSTTNWFTSPDAKIQQIDNTSILVIPNWSTQVSQNINLPQQNHQYLLRVIAKKEGIGNGYVKISDCTKHVETLIFTSCDYNNNAMWNEPMGYVTKTMHITPHTNQVRIDIGETEGTFKINSVELIGIKN

SEQ ID NO: 83 - protein, 688 aa, Artificial sequence
  variant of native sequence
MYNIEIQIRTGGTFMNHNNNNNEYEIIDSHTSSYPSNRNSNHSRYPYTNNPNQPLSNTNYKDWLTMCQGNQPYRDKPQTLVDTGVAISTGLIIIGTIMTGFPALTPWGIGIVSFGTLLPVLWPSGETDKKVWIDFMNYGGTIFKPLLNEQKDQAQRILQGFHLPINSYQNGITTWQNLRKSHIPGTPPSSALREAARVARTRIDIANSALSRISEIQSAQFGAAILPFYAQAATLHLNLLSQAVQFADQLKADAENQPTQDAGTSDEYHRLLKQYTQQYTDYCVKTYQEGLTTLKNAPDMTWNIYNTYRRDMTLLVLDYIALFPNFDIRQYPTGTHSELTREIYTDALIKEQPNPPIPIPVAQRETELTRPPHLFSRLNRLLLFSNTDPSPPALSAVQNSFTYTNNNIVQYSQIYRLINSPEPTGSTQQIIISNTDIYRIELTLRQNYFITHNINFYTLDGITRRYNSGSTPETPIIINFQLPEFPADKIPPYGLGTKYSHILSYMKISPNRHNIVLPNERHLSFAWTHTSVNFDNEISNQIVTQIPAVKARSLDTSSSVISGPGHTGGDLVLFRSRMEFQCFVPTQTKYKIRMRYVAYSPNNSISLTLNIMGQVNYGLRALNIKSTVASEKDTVNPKYNDFQYLYFYTQDPNEIAIVNLYSLTNMTLQSNNFAGNTLVIDKIEFLPV

SEQ ID NO: 84 - protein, 387 aa, Unknown
  Bacillus sp. obtained from an environmental sample
MANLKLDKFYQISPVISPGKIVQVGWGADSDGDVLEQFPPDRYQDAWHQFLFVPLDYGNYAIVCKNSGKVVSVSHRDNGDGRWIEQWDWLSDVNDQEAQHIKLNDTPNSGTYYFQFQHSGKYMAVSWRNSNDGNYMEQWQFEGKDWQQFKVEELSNSITLPTATIKPRPVAPDYTGTNINETLPESSEKAITAASLVPFFMVDDPFYNDSATQFNASPYYLLEKTEQWIRISTNIVSPGDKIVYTRKVGISEAHQTTMQSTVDMSLGVDIGLQFRALSGALSANISTQLSMTESTTTTQMKEETITREILNNADESDSFTIYQLETQFHLKRSDRSYVIDPWAARFERDTVTRSYLQSIQTTDNTLRAETSAELQKRLINKKSYLRS

SEQ ID NO: 85 - protein, 777 aa, Unknown
  Bacillus sp. obtained from an environmental sample
MQRNNKQFTNWKKQLMKAVPVCVLSTGFLCGVANTALAAEKTDVKTAVTAKQVHTVQNGNIKEATKAPAVGSFASNPEDDLSVLGKAIKDAAQAGSAGIDPNILQEAANNDYTDIAKSILKITAMAGSAGFAPLGVLVPLIDAFFPSGDKPTLIQQITPAVQKMIDANDVKNRANTLDGYINGLKAPLADYGNYVRAVQNGKFLDGRTPTQKDRQEAMERMSKNIENIKQTINKDQKLKSVLKSETLKQLNDNQNQKNGANSDVDILAGEINTVNTAFETALAQFEQGVSDSSTRIAETTVPYYAQFVTMYTTFLHDVVTNGSKWGISNAVISTMHDDLQKLIPHATQQIHDMYLTAQKYAEQIEHSEPGITTHKREADEALIPSLNLAAMWTTMSDDYKGHAVHLDQSKTITTHEIGQIQDSWSPSFRDTATEFYDGTLLMHLDDEYFQTTTNIGESFRDSTGARHGYVYGEATPSGYAVKTEGGEIDPNNPITSVWMTGVNDATSRVHFGPAGVGSDPQMAGSVNIPGYKLNWLDANYTTGVSGSEGRSVITNAFARFIPKDLVPENTVRSENVITGIPFEKYDRSKAFNYYGRAHESVNGADAVTTRPKQPGENGPWMSVKFHVDKDGDYNLRYRAATTRDGNLFIAQDGAMNANSVKIQNTSADANAVQGDLGKYGLSENLPVHLTAGDHSVEIMVPDEMLGNMTLDRLEFVPVDTSAQKSFKPATPTVKISKELAANFTKKVNSEDKTKKDDVKASADTSKNPEDSKNREKQ

SEQ ID NO: 86 - protein, 740 aa, Artificial sequence
  variant of native sequence
MAEKTDVKTAVTAKQVHTVQNGNIKEATKAPAVGSFASNPEDDLSVLGKAIKDAAQAGSAGIDPNILQEAANNDYTDIAKSILKITAMAGSAGFAPLGVLVPLIDAFFPSGDKPTLIQQITPAVQKMIDANDVKNRANTLDGYINGLKAPLADYGNYVRAVQNGKFLDGRTPTQKDRQEAMERMSKNIENIKQTINKDQKLKSVLKSETLKQLNDNQNQKNGANSDVDILAGEINTVNTAFETALAQFEQGVSDSSTRIAETTVPYYAQFVTMYTTFLHDVVTNGSKWGISNAVISTMHDDLQKLIPHATQQIHDMYLTAQKYAEQIEHSEPGITTHKREADEALIPSLNLAAMWTTMSDDYKGHAVHLDQSKTITTHEIGQIQDSWSPSFRDTATEFYDGTLLMHLDDEYFQTTTNIGESFRDSTGARHGYVYGEATPSGYAVKTEGGEIDPNNPITSVWMTGVNDATSRVHFGPAGVGSDPQMAGSVNIPGYKLNWLDANYTTGVSGSEGRSVITNAFARFIPKDLVPENTVRSENVITGIPFEKYDRSKAFNYYGRAHESVNGADAVTTRPKQPGENGPWMSVKFHVDKDGDYNLRYRAATTRDGNLFIAQDGAMNANSVKIQNTSADANAVQGDLGKYGLSENLPVHLTAGDHSVEIMVPDEMLGNMTLDRLEFVPVDTSAQKSFKPATPTVKISKELAANFTKKVNSEDKTKKDDVKASADTSKNPEDSKNREKQ

SEQ ID NO: 87 - protein, 718 aa, Artificial sequence
  variant of native sequence
MQRNNKQFTNWKKQLMKAVPVCVLSTGFLCGVANTALAAEKTDVKTAVTAKQVHTVQNGNIKEATKAPAVGSFASNPEDDLSVLGKAIKDAAQAGSAGIDPNILQEAANNDYTDIAKSILKITAMAGSAGFAPLGVLVPLIDAFFPSGDKPTLIQQITPAVQKMIDANDVKNRANTLDGYINGLKAPLADYGNYVRAVQNGKFLDGRTPTQKDRQEAMERMSKNIENIKQTINKDQKLKSVLKSETLKQLNDNQNQKNGANSDVDILAGEINTVNTAFETALAQFEQGVSDSSTRIAETTVPYYAQFVTMYTTFLHDVVTNGSKWGISNAVISTMHDDLQKLIPHATQQIHDMYLTAQKYAEQIEHSEPGITTHKREADEALIPSLNLAAMWTTMSDDYKGHAVHLDQSKTITTHEIGQIQDSWSPSFRDTATEFYDGTLLMHLDDEYFQTTTNIGESFRDSTGARHGYVYGEATPSGYAVKTEGGEIDPNNPITSVWMTGVNDATSRVHFGPAGVGSDPQMAGSVNIPGYKLNWLDANYTTGVSGSEGRSVITNAFARFIPKDLVPENTVRSENVITGIPFEKYDRSKAFNYYGRAHESVNGADAVTTRPKQPGENGPWMSVKFHVDKDGDYNLRYRAATTRDGNLFIAQDGAMNANSVKIQNTSADANAVQGDLGKYGLSENLPVHLTAGDHSVEIMVPDEMLGNMTLDRLEFVPV

SEQ ID NO: 88 - protein, 681 aa, Artificial sequence
  variant of native sequence
MAEKTDVKTAVTAKQVHTVQNGNIKEATKAPAVGSFASNPEDDLSVLGKAIKDAAQAGSAGIDPNILQEAANNDYTDIAKSILKITAMAGSAGFAPLGVLVPLIDAFFPSGDKPTLIQQITPAVQKMIDANDVKNRANTLDGYINGLKAPLADYGNYVRAVQNGKFLDGRTPTQKDRQEAMERMSKNIENIKQTINKDQKLKSVLKSETLKQLNDNQNQKNGANSDVDILAGEINTVNTAFETALAQFEQGVSDSSTRIAETTVPYYAQFVTMYTTFLHDVVTNGSKWGISNAVISTMHDDLQKLIPHATQQIHDMYLTAQKYAEQIEHSEPGITTHKREADEALIPSLNLAAMWTTMSDDYKGHAVHLDQSKTITTHEIGQIQDSWSPSFRDTATEFYDGTLLMHLDDEYFQTTTNIGESFRDSTGARHGYVYGEATPSGYAVKTEGGEIDPNNPITSVWMTGVNDATSRVHFGPAGVGSDPQMAGSVNIPGYKLNWLDANYTTGVSGSEGRSVITNAFARFIPKDLVPENTVRSENVITGIPFEKYDRSKAFNYYGRAHESVNGADAVTTRPKQPGENGPWMSVKFHVDKDGDYNLRYRAATTRDGNLFIAQDGAMNANSVKIQNTSADANAVQGDLGKYGLSENLPVHLTAGDHSVEIMVPDEMLGNMTLDRLEFVPV

SEQ ID NO: 89 - protein, 657 aa, Unknown
  Bacillus sp. obtained from an environmental sample
VKNMNSYQNTNEYEILDGSPNNTNMSNRYPFAKDPNIFPINLDACQGRPWQDTWESVSDIVTIGTYLIQFLLEPGIGGIPVILSIINKLIPSSGQSVAALSICDLLSIIRKEVDESVLSDGVADFKGEMTAYRDYYLPYLEDWLTDKSNPEKLADVVKQFQAREEDFTKLLAGSLSRQKAEILLLPTYVQAANVHLLLLRDAVKYKKEWGLVCPPLYPGSGRTDCNERLKAKIKEYTNYCVEWYNKGLDQIKQAGTSTETWLKFNKFRREMTLAVLDVIAIFPTYDFEKYPLATNVELTREVYTDPVGYSGSSIRWERTFPNAFNTLEANGTRGPGLVTWLEVLGIYNHDFQDITVYFSGWVGSRHSEDYTRGNGTFSRISGTTSNDIRNQTFYSRDVFKIDSLGIYETRAELGYTRQRFCVSRAVFSSTLYNYVYDARNNGQGRMTIESMLPGIKNPIPSSQDYSHRLSNAACVQFNDSRINVYGWTHTSMTKNNPIYTDKISQIPAVKAFALESGAYVSRGPGHTGGDVVTLPNRGRLKIRLTSAPTNKNYRVRVRYATSYGADLMVQRWSPSGNHASGYFSGSPTGSYPTFGYMNTLVTTFNQSGVEIIIENRHYSNIIIDKIEFIPDDITTLEYEGERDLEKTKNAVNDLFTN

SEQ ID NO: 90 - protein, 631 aa, Artificial sequence
  variant of native sequence
VKNMNSYQNTNEYEILDGSPNNTNMSNRYPFAKDPNIFPINLDACQGRPWQDTWESVSDIVTIGTYLIQFLLEPGIGGIPVILSIINKLIPSSGQSVAALSICDLLSIIRKEVDESVLSDGVADFKGEMTAYRDYYLPYLEDWLTDKSNPEKLADVVKQFQAREEDFTKLLAGSLSRQKAEILLLPTYVQAANVHLLLLRDAVKYKKEWGLVCPPLYPGSGRTDCNERLKAKIKEYTNYCVEWYNKGLDQIKQAGTSTETWLKFNKFRREMTLAVLDVIAIFPTYDFEKYPLATNVELTREVYTDPVGYSGSSIRWERTFPNAFNTLEANGTRGPGLVTWLEVLGIYNHDFQDITVYFSGWVGSRHSEDYTRGNGTFSRISGTTSNDIRNQTFYSRDVFKIDSLGIYETRAELGYTRQRFCVSRAVFSSTLYNYVYDARNNGQGRMTIESMLPGIKNPIPSSQDYSHRLSNAACVQFNDSRINVYGWTHTSMTKNNPIYTDKISQIPAVKAFALESGAYVSRGPGHTGGDVVTLPNRGRLKIRLTSAPTNKNYRVRVRYATSYGADLMVQRWSPSGNHASGYFSGSPTGSYPTFGYMNTLVTTFNQSGVEIIIENRHYSNIIIDKIEFIPD

SEQ ID NO: 91 - protein, 568 aa, Unknown
  Bacillus sp. obtained from an environmental sample
LLFNKYAKKVVSPMFTSGTKNTLKIETTDYEIDQAAISIECMSDEHSPKEKMMLWDEVKRAKQFSQSRNLLQNGDFGDFPRNDWTFGNDIIIGSNNSIFKGNFLQMSGARDIYGTIFPTYIYQKIDESKLKTYTRYRVRGVVGSSKDLRLMVTRYGKEIDAIMNVPNDLVYTQPNPSCGDYRCESSSQYVNQGYPTPYTDGYGVGYPSNQGEKRVKCHDRHSFDFHIDTGELDINTNLGILVLFKISNPDGYATLGNLEVIEEGPLTDEALAHVKQKEKKWNQHLEKARMETQQANEPAKQAVDTLFTNEQELHYHITLDHIQNADRLVQLIPYVHHAWLPDAPGMNYDVYQGLNARIMQAYNLYDARNVITNGDFTQGLQGWHAAGKATVQQMDGSSVLVLSNWSAGVSQNLHAQDHHGYMLRVIAKKEGPGKGYVTMMDCNGNQETLKFTSCEEGYMTKTVEVFPDSDRVRIEIGETEGTFYIDSIELICMQGYASNNNPHTGNMYEQSYTRNFNQNTSDVYHQGYTNNYNQDSSNMYNQNYTNNDNLHSGCTCNQGHNSGCTCNR

SEQ ID NO: 92 - protein, 711 aa, Artificial sequence
  variant of native sequence
MNQNNNEYEIADVNPPSYPSNRINNYSRYPFANDPNQLLQQTNYKDWLNICQGNNQNSGNLITDAGAAVSAGIIVTGTMIAAFAALAVAPFPIVGAIVGGIVIAFGTLLPLVWPGGKEDRTVWTQFFALGETLLGKRLTDDAQKTAAETVDGFGRVLDNYKVALNSWMDLKKKQSPGSPPTTELKEAADNVKQRFEIVHNEFDANMPHLGNPKSNYKEVLLSSYAHAANLHLNLLQQGVRFADQWNQDIYSSQIVPAAGTSTEYLKFLQARIQEYVNYCTATYRSGLNILKNSNDITWDIYNTYRRDMTLTVLDLVAAFPNYDPTYYPIDTKIQLTRTIYSNLLGITQSGRQYFEALENALTMRPNLYRILRGFNFNTTFGSGVNYLSGIANRRGLIKTVPSEEDEQPFYGQSNGRHDPMIFANGLNIFRVTLLRNKHYIALPVGPPLFAANQITDLKLYYGNATQYHHYQPSNEGLTTESTDLSFPPKNEEYLNAILMTSPRTIYENPTNIYSFAWTKKDIDQQNNIIINAITQIPAVKGIALGNQSRVIQGPGHTSGDLVYLKDSLELRCQYTGPQQSYDVRIRYASNGILNDRAMIAITIPGVTGQSISLSETFSGTDYNVLEFQNFKSVQFTSAIRLNPSQNIFIYLNRLDQNANTTLLIDKIEFIPHPLPRILSEQKLKKVKQKVNDLFIDAENGCFCPSHEKDLR

SEQ ID NO: 93 - protein, 672 aa, Artificial sequence
  variant of native sequence
MNQNNNEYEIADVNPPSYPSNRINNYSRYPFANDPNQLLQQTNYKDWLNICQGNNQNSGNLITDAGAAVSAGIIVTGTMIAAFAALAVAPFPIVGAIVGGIVIAFGTLLPLVWPGGKEDRTVWTQFFALGETLLGKRLTDDAQKTAAETVDGFGRVLDNYKVALNSWMDLKKKQSPGSPPTTELKEAADNVKQRFEIVHNEFDANMPHLGNPKSNYKEVLLSSYAHAANLHLNLLQQGVRFADQWNQDIYSSQIVPAAGTSTEYLKFLQARIQEYVNYCTATYRSGLNILKNSNDITWDIYNTYRRDMTLTVLDLVAAFPNYDPTYYPIDTKIQLTRTIYSNLLGITQSGRQYFEALENALTMRPNLYRILRGFNFNTTFGSGVNYLSGIANRRGLIKTVPSEEDEQPFYGQSNGRHDPMIFANGLNIFRVTLLRNKHYIALPVGPPLFAANQITDLKLYYGNATQYHHYQPSNEGLTTESTDLSFPPKNEEYLNAILMTSPRTIYENPTNIYSFAWTKKDIDQQNNIIINAITQIPAVKGIALGNQSRVIQGPGHTSGDLVYLKDSLELRCQYTGPQQSYDVRIRYASNGILNDRAMIAITIPGVTGQSISLSETFSGTDYNVLEFQNFKSVQFTSAIRLNPSQNIFIYLNRLDQNANTTLLIDKIEFIPH

SEQ ID NO: 94 - protein, 657 aa, Artificial sequence
  variant of native sequence
MNQYYNNNEYEILDNGVQCCSPRYPLAQAPGSEWQNMNYQDVMNTSVGREYQAVQQVNVGEAVGAALGILTTILKAVNPTLGTAAGVISSIFGFLWKRFGTDPQAQWKQFMEAVEYLVSQKITDAVRSKAVSELEGVQRAVELYQEAANAWNMNPDNAAAKERIRRQYTSTNTVIEYAMPSFRVGSFEVPLLTVYAQAANLHLLLLRDAVKFGAGWGFSPTEVEDNYTRLQARTAEYTNHCTNTYDKGLKQAYDLAPNPTDYNKYPYLNPYSKDPIYGKYYTAPVDWNLFNDFRRDMTLMVLDIVAVWPTYNPRLYNNPNGVQIQLSREVYSTVYGRGWSNNSTVDAIESTLVRPPHLVTELTKLTFDERNLYEAETVPVAFRKVTNTLHYVGSSTTWEQSFSATPVGSLKAVHNVLATDIGNLALSLGAVPLGFSFYNKNDQHITTVGYSGGWWNGIPKDEGSNQNSHHLSYVAALETQTTAGWFPTYPVPLLGEWGFGWQHNSLKYTNRLVTNQINQLPAVKASALVNHARVSKGTTGTGGNIIELVNPNCGFIFNFYAEPENPQGQAFNIRIRYSATVPGKLNIRHLESGKEFMNTPRDFKGTTTGTNWIPKFQEYQYLDLGPIVLRTGMNYGFKIELASGQLVSIDKIEFLPF

SEQ ID NO: 95 - protein, 820 aa, Artificial sequence
  variant of native sequence
MAQLPELQAQSFIPYNVLANPVTGNSAGTDWGEWLSSLKEAWTEFQKTGSDKFLQSVLSTGYDAAQGGSFNYIAVLQAGVAILGTVLGAEFPGITAIAVPALTFLIKWVWPKLTGGSAGESDTQKMLDLIDKEIQQKLDQALSQQDINNWRAYLTSIFEAATNLSQSIIDAQFTGTERSSDRQPRVPTSSDYEDVYTKLNIADAVLSPSTNNILTGNFDVLAIPYYTIGATVRITAYQSFVKFANQWIDVVYPDQTSNTWLKAHQNLDNAKDKMIAMIQQYTANVLRVFTDPKNMPPLGKDKKSINAYNKFVRGMVISGLDLVAVWPSLYPDDYQVQTDLEKTRVIFSDLIGKDQTISNDVTLINMADGKDGSGAFNQHAAIDLNSIFYYHEELSSMQLGIHDGSRGNTTNCYDYGIIANYPNHSYFYGDLYSPSGDATFSAPLNVLNAQTQYSSGYVDSEFIYNSDPSAYGLGCHILGGCTKGDCYNQSSCSEGFGYSCNTSLPSQKINAFYPFKMNLNRSGTSDKLGLMYSLVPLDLSPNNVFGELDSDTRNVIGKGFPAEKGTLSYGRQPMLVREWVNGANAVKLSDVPLTLQMTNMTSGKYYIRVRYANTSNAEISINQQVYAGNQNVQNGGWSLPSTTASNVATNFPNQLYITGINGNYVLEDITWGVDGQGKPITIPSGDVTVTLSRTNMSQSGDLFIDRVELVPAAPQSDYINYSITSQIPNCNNFDTIIWDGNGAQRSTATVTVSGLPDNNGILISGLSSYGWQPLQDVNGHGNNWVTNGGPFTLSNDHTFTAISICGFQNVSSGKITGKLS

SEQ ID NO: 96 - protein, 712 aa, Artificial sequence
  variant of native sequence
MAQLPELQAQSFIPYNVLANPVTGNSAGTDWGEWLSSLKEAWTEFQKTGSDKFLQSVLSTGYDAAQGGSFNYIAVLQAGVAILGTVLGAEFPGITAIAVPALTFLIKWVWPKLTGGSAGESDTQKMLDLIDKEIQQKLDQALSQQDINNWRAYLTSIFEAATNLSQSIIDAQFTGTERSSDRQPRVPTSSDYEDVYTKLNIADAVLSPSTNNILTGNFDVLAIPYYTIGATVRITAYQSFVKFANQWIDVVYPDQTSNTWLKAHQNLDNAKDKMIAMIQQYTANVLRVFTDPKNMPPLGKDKKSINAYNKFVRGMVISGLDLVAVWPSLYPDDYQVQTDLEKTRVIFSDLIGKDQTISNDVTLINMADGKDGSGAFNQHAAIDLNSIFYYHEELSSMQLGIHDGSRGNTTNCYDYGIIANYPNHSYFYGDLYSPSGDATFSAPLNVLNAQTQYSSGYVDSEFIYNSDPSAYGLGCHILGGCTKGDCYNQSSCSEGFGYSCNTSLPSQKINAFYPFKMNLNRSGTSDKLGLMYSLVPLDLSPNNVFGELDSDTRNVIGKGFPAEKGTLSYGRQPMLVREWVNGANAVKLSDVPLTLQMTNMTSGKYYIRVRYANTSNAEISINQQVYAGNQNVQNGGWSLPSTTASNVATNFPNQLYITGINGNYVLEDITWGVDGQGKPITIPSGDVTVTLSRTNMSQSGDLFIDRVELVPA

SEQ ID NO: 97 - protein, 787 aa, Artificial sequence
  variant of native sequence
MNSYQNKNEYEILDASENTVNALNRYPFANNPYSSIFSSCPRSGPGNWINILGNAVSEAVSISQDIISLLTQPSISGIISMAFSLLSRMIGSNGRSISELSMCDLLAIIDLRVNQSVLDDGVADFNGSLVIYRNYLEALQRWNNNPNPANAEEVRTRFRESDTIFDLILTQGSLTNGGSLARNNAQILLLPSFANAAYFHLLLLRDANVYGNNWGLFGVTPNINYESKLLNLIRLYTNYCTHWYNQGLNELRNRGSNATAWLEFHRFRRDMTLMVLDIVSSFSSLDITRYPRATDFQLSRIIYTDPIGFVNRSDPSAPRTWFSFHNQANFSALESGIPSPSFSQFLDSMRISTGPLSLPASPNIHRARVWYGNQNNFNGSSSQTFGEITNDNQTISGLNIFRIDSQAVNLNNTTFGVSRAEFYHDASQGSQRSIYQGFVDTGGASTAVAQNIQTFFPGENSSIPTPQDYTHILSRSTNLTGGLRQVASGRRSSLVLHGWTHKSLSRQNRVEPNRITQVPAVKASSPSNCTVIAGPGFTGGDLVRMSSNCSVSYNFTPADQQVVIRLRYACQGTASLRITFGNGSSQIIPLVSTTSSINNLQYENFSFASGPNSVNFLSAGTSITIQNISTNSNVVLDRIEIVPEQPIPIIPGDYQIVTALNNSSVFDLNSGTRVTLWSNNRGAHQIWNFMYDQQRNAYVIRNVSNPSLVLTWDFTSPNSIVFAAPFSPGRQEQYWIAESFQNSYVFENLRNTNMVLDVAGGSTAIGTNIIAFPRHNGNAQRFFIRRP

SEQ ID NO: 98 - protein, 644 aa, Artificial sequence
  variant of native sequence
MNSYQNKNEYEILDASENTVNALNRYPFANNPYSSIFSSCPRSGPGNWINILGNAVSEAVSISQDIISLLTQPSISGIISMAFSLLSRMIGSNGRSISELSMCDLLAIIDLRVNQSVLDDGVADFNGSLVIYRNYLEALQRWNNNPNPANAEEVRTRFRESDTIFDLILTQGSLTNGGSLARNNAQILLLPSFANAAYFHLLLLRDANVYGNNWGLFGVTPNINYESKLLNLIRLYTNYCTHWYNQGLNELRNRGSNATAWLEFHRFRRDMTLMVLDIVSSFSSLDITRYPRATDFQLSRIIYTDPIGFVNRSDPSAPRTWFSFHNQANFSALESGIPSPSFSQFLDSMRISTGPLSLPASPNIHRARVWYGNQNNFNGSSSQTFGEITNDNQTISGLNIFRIDSQAVNLNNTTFGVSRAEFYHDASQGSQRSIYQGFVDTGGASTAVAQNIQTFFPGENSSIPTPQDYTHILSRSTNLTGGLRQVASGRRSSLVLHGWTHKSLSRQNRVEPNRITQVPAVKASSPSNCTVIAGPGFTGGDLVRMSSNCSVSYNFTPADQQVVIRLRYACQGTASLRITFGNGSSQIIPLVSTTSSINNLQYENFSFASGPNSVNFLSAGTSITIQNISTNSNVVLDRIEIVPE

SEQ ID NO: 99 - protein, 846 aa, Artificial sequence
  variant of native sequence
MAQLQELQIQPVIPYNVLASPQIGNLDTQPGSLDDLIESLKEAWTEFQKTGSDKLLQTTLQNGFSAASGGSFNYLAVLQAGIGLFGTLGAEIPGVAVAAPILSMVIGWLWPHKSGDDGQQLVDLIDAEIQKQLNQALSTQDKHNWVGYLDESFLNASHNVARAVTNAQFVGTEGNYTAPRTPTASDYTTVETTLFSTEGSYHTGLSQMLNGNFDTLALPFYVIGVTMQLATYQTFIQFGEKWIDVVWPDNQTPGTTGYTHYQTLQDKKTDMRTFIQQHTTTVYNAFKKGMPPLESNKNSINAYNVYVRGMVLNGLDMVATWPSMYPDDYPTQMALEQTRVIFSDMVGQDQTRDGNTTIYNIFDSTSNFQHGTTDINSIHYFPDELQQAQIAEYSPSRGNHCYPYGIILNYQHNTYRYGDNDPGTSGTVFPAPMRSINAKTQNTSYLNSENLFTDLGSSTNCYIPGTCTNNCSPGSSCTNGSGYGESCNVPLPNQKINALYPFTQEHVSGDSGKLGLMASLVPYGLSPNNVFGEFDSDTQAIIGKGFPAEKGYIGNGSPVSVVREWVNGANAVQLPAWDTFKITATNLAADQYHIRVRYASTAAYPTNAKYPLSYYVLAGDTILQQGKWEAIDTSQADITKQVYVTGQQGNYILTDILGENPITLPKDEITVQLLQGNPAGGMTKVLIDRIEFVPAVINVLNPQLNYQISSQLPAWNNNQSMDPFPTIWRANPGIVGTSANITVADLLDMSGFKYTNITALDLGGQVGLFAKIGIGTDSDPNNWKWMCPDGQGENPWIGDGTYNFNPKNSGSCFDKSFTAIKLVGGTSFDTFIAAGILTGTVTTQKS

SEQ ID NO: 100 - protein, 696 aa, Artificial sequence
  variant of native sequence
MAQLQELQIQPVIPYNVLASPQIGNLDTQPGSLDDLIESLKEAWTEFQKTGSDKLLQTTLQNGFSAASGGSFNYLAVLQAGIGLFGTLGAEIPGVAVAAPILSMVIGWLWPHKSGDDGQQLVDLIDAEIQKQLNQALSTQDKHNWVGYLDESFLNASHNVARAVTNAQFVGTEGNYTAPRTPTASDYTTVETTLFSTEGSYHTGLSQMLNGNFDTLALPFYVIGVTMQLATYQTFIQFGEKWIDVVWPDNQTPGTTGYTHYQTLQDKKTDMRTFIQQHTTTVYNAFKKGMPPLESNKNSINAYNVYVRGMVLNGLDMVATWPSMYPDDYPTQMALEQTRVIFSDMVGQDQTRDGNTTIYNIFDSTSNFQHGTTDINSIHYFPDELQQAQIAEYSPSRGNHCYPYGIILNYQHNTYRYGDNDPGTSGTVFPAPMRSINAKTQNTSYLNSENLFTDLGSSTNCYIPGTCTNNCSPGSSCTNGSGYGESCNVPLPNQKINALYPFTQEHVSGDSGKLGLMASLVPYGLSPNNVFGEFDSDTQAIIGKGFPAEKGYIGNGSPVSVVREWVNGANAVQLPAWDTFKITATNLAADQYHIRVRYASTAAYPTNAKYPLSYYVLAGDTILQQGKWEAIDTSQADITKQVYVTGQQGNYILTDILGENPITLPKDEITVQLLQGNPAGGMTKVLIDRIEFVPAV

SEQ ID NO: 101 - protein, 1236 aa, Artificial sequence
  variant of native sequence
MNQNDQNEIQIIDSSSNDFNQSNRYPRYPLAEESNYKDWLANCKESNLDRLSTPSSVQDAVVTSLNIFSYIFGFLDFGATSAGLGILGALFGVFWPSSNNGISEDLLRSIEILIDRRINEVERNRITVQFEGLRAVMSNYNTALRNWNANRNNPALQSEVRSRFDNADDAFAGRMPEFRIPGFEIQSLSVYAQAATLHLLLLRDAVVNGSLWGFDGETIESYYTKLVCLIDAYADHCASFYRQGLQELRDRGNWNAFNNYRRDMTITVLDIISLFSNYDPRRYTINTNTQLTREVYTEPVATPGWLNLNSNPDQFQQIENDLIRPLRPSSTLAALSAETAFAFFQSGQTPLRAILRTRTSHFNISGGFGTDPWQGSPNPTGPSESQLQFENFDVYHVSSEVTREVSSENSGLFGPQRINFRMVSISGVVASREISSPPFGRYITNISSSIPGIRSANPTASDYTHRLSSIRSTSLRTMYRDRTNIIAYGWTHTSLELTNRLLPNRITQIPAVKSSITPLPIVGGPGHTGGGLVSLAGYGRYMLINFISPYSPSRQRYRLRIRFVKDFDDAHLRVSISAANFYQNVVLPGSRTSVNPNLSFRDFRYVDVPGEFELVANRSYSINLGAPTSSIPGTCLIDKIEFIPVNSAALEYEGEQSLKKAKKAVDDLFTNDLKNDLKIETTDYDVDQAANLVECVPEELYAKEKMILLDEVKHAKQLSESRNLIQNGNFEFYTDKWTTSNNASIQADNPIFKGNYLNMPGARETEAGATTFPTYVFQKIDESKLKPYTRYKARGFVGGSKEVRLIVARYAEEVDAIMNVRNDLTPGVPVASCGEFDRCHPQAYPILQDRCHDDRIEQHADGGSHSCHGKSREKHAICHDSHQFDFHIDTGEVYLTENPGIWVLFKISSPEGYATLDNIELIEEGPLVGESLALVKKREKKWKNEMETKWIHTKEAYEKAKWAVDALFTTPQDTALKFETIISNIISAEHLVQSIPYVYNKWLADVPGMNYDIYTELKRRITQAYSLYERRNIIKNGDFHQGLAHWHATPHARVQQIDGTAVLVIPNWGSNVSQNLCVEHNRGYVLRVTAKKEDMGKGYVTISDCAKNTETLTFTSCDYVSNTSTSDHPRTCNSCDDYVSNESINDQPDYLLNQERNESRCYNRNASTSEESDYLLNQKRNEQWSNHSDATVNEQMNYVTRTIDFFPDTDRVRIDIGETEGIFKVESVELICMEGQ

SEQ ID NO: 102 - protein, 645 aa, Artificial sequence
  variant of native sequence
MNQNDQNEIQIIDSSSNDFNQSNRYPRYPLAEESNYKDWLANCKESNLDRLSTPSSVQDAVVTSLNIFSYIFGFLDFGATSAGLGILGALFGVFWPSSNNGISEDLLRSIEILIDRRINEVERNRITVQFEGLRAVMSNYNTALRNWNANRNNPALQSEVRSRFDNADDAFAGRMPEFRIPGFEIQSLSVYAQAATLHLLLLRDAVVNGSLWGFDGETIESYYTKLVCLIDAYADHCASFYRQGLQELRDRGNWNAFNNYRRDMTITVLDIISLFSNYDPRRYTINTNTQLTREVYTEPVATPGWLNLNSNPDQFQQIENDLIRPLRPSSTLAALSAETAFAFFQSGQTPLRAILRTRTSHFNISGGFGTDPWQGSPNPTGPSESQLQFENFDVYHVSSEVTREVSSENSGLFGPQRINFRMVSISGVVASREISSPPFGRYITNISSSIPGIRSANPTASDYTHRLSSIRSTSLRTMYRDRTNIIAYGWTHTSLELTNRLLPNRITQIPAVKSSITPLPIVGGPGHTGGGLVSLAGYGRYMLINFISPYSPSRQRYRLRIRFVKDFDDAHLRVSISAANFYQNVVLPGSRTSVNPNLSFRDFRYVDVPGEFELVANRSYSINLGAPTSSIPGTCLIDKIEFIPV

SEQ ID NO: 103 - protein, 700 aa, Artificial sequence
  variant of native sequence
MSSYNKNPFETIKELLSNANVSITCPLHPLAKEPTAVLQGMNYKDWLVMSEEENSLGKPENFDSETIQNALIGTLAVIGFIASVLITPITGGASVAIGSALLLETIPYYWGLAESEDPTIQEKAMFDDIMKATEKTIKSEIEKVVKTKAESELTSLRDVFKYYTRALNLWKENKDNQDARKEVSSRFRAAHVAFIGAMSQFKMPGYELVMLPIYAAAANFHLMLLQDGMIYEKEWNESNNLTEDFYYKEYQNWTSQYIDHCTSWYQKGLKDIKDNKEKNWVDYNSYRNNMTILVLDLIALFPSYDVRQYNNMGVKLETHTRTLYSNPLKFSKGSRIDDDERVYTREPNLFSSLSHLEFHTRTTNLGSDGIEFLSGIEKKYQLTEKESYRTKFEGKPTDIGKKHEIPFKKDESEFYSLYELSTEGKGFKDSTKLPLIQKMTFNNEEGKKFEYSVDKFGNGALEKESFSITNPDDLLADQKARHVLSDIIFVDDKNISPEQIQTRDYSFAWTSEQISPYNRITDGTKNKDGSISYQITQVPAVKAYSLKSSKDTSHIDVISGPGFTGGDLVRCAIKKTASSTGVTQLSIVFPITFNHVKTDKYRVRMNYAADHTKLITLVGGSNPISGTIENTFDAKDTGKSLKYNNFKMMEFNIATNFKDEEKQKIITLKLTYADDDQAIADGKVAQLWIDKLEFIPVPTK

SEQ ID NO: 104 - protein, 502 aa, Artificial sequence
  variant of native sequence
MNSEQRKHGQNNEYKHQNHGVSCNCGCQQGKYEYEQKQDREEYNNSYMSNEQTQNHEGMGYLVAKEGTRNDMYNSVKREFREHDMYHENKNYYSCSPRQFNTLNLPDESKRFQTITHVQNTNSNPSLNATSTTRGQNIDGSNNFCRSISLDFQLINQDLNTTQDTFYYLFYLLDSGDFIIANYGTGRVLENRTVEPDERAIISSLYTGSVSQFFRKRSSVNNQFILSPQQELNRAVNVCNNTINLATKITSGFNIPDNTSNVFRHIVASNRPITIPSFSNESTLGPAPVLTSLSDYGPSPAQAERAVIGSALIPCIFVNDVLPLERRIKESPYYVLEYRQYWHRLWTDEIPSGDRRSFGEITGILPNAQASMRDMIDMSIGADWGLRFGDSSTPFKRGILNSLNTQGSYADVDLGTQTGSNQLTNFNSFSVRYARFVKAHEYRLTRSNGTVVTTPWVALDYRVPQTARFPLNAQLSQNYKIISSYNSYDLPVLEHTDNKKKW

SEQ ID NO: 105 - protein, 806 aa, Artificial sequence
  variant of native sequence
MHQTNTSKDKNRMASFEKTNMSNEGPIYPLANSSNTGLQGMNYNDSVNMHATKNEDCLLSSRVSVDPKTAVATGIKISTFIMSALGIPLASQIGQLWNFVLDQLWPNGDNQWEEFMKHVEELINQKITEYARDKALAELEGLGNVLELYQEAIEDWKKDPTNVASQERVRTRFRNADAFFENGMPSFRIKNYEVPLLSVYASAANLHLLLLRDASIYGKDWGLNETNVKDNYNRQLKRTESYSNHCVTWYQKGLQRLKGSDADSWLKFNAFRRDMTFTVLDIVVLFPCYDIQKYPMGVKTEITREIYTDPIGNLPRRPGFQVLDWVNHAPSFEEIEKETTGDPSMVTWINYLEISRNKLGGWNSSNDYWEGHSVHYKYSNDGIVIDSKAYAHGDFSGKFPTEAIHLENCDVYASSSLPVAASNPYGDKASFGVTKVYFDMLNLNDNTLQRGSWDHPKNWGGSWVDLKFLNETPNIKEIQKYSHKLTYVSSFSVDYGSVLCYRWRHSSVDRNNTLDPQKITQISAVKGHTPINCEVVRGNGLTDGDWLQLKGGGSFTLNVSSVIPKTYRIRLRYACGPKDVNLTVSCPDNGIDKTITIPSTSTASLANNLMYKDFKYIDLPIEFITSAAPKRCRINLRLEGVQNTSFFMDKFEFIPENETETRPWKIVTALNNSSVLAFAKNSLYKEAILSNDTGEESQKWRFIYDEEKKAYQIEDVKSPRLILAWIIDGPESRKVWATRSQNIDEHYWILEEQEDSYFIIKNKKNPSLVLDVDGAQTNQGTKIKVNERHPLYSSRTNAQKFKLERV

SEQ ID NO: 106 - protein, 656 aa, Artificial sequence
  variant of native sequence
MHQTNTSKDKNRMASFEKTNMSNEGPIYPLANSSNTGLQGMNYNDSVNMHATKNEDCLLSSRVSVDPKTAVATGIKISTFIMSALGIPLASQIGQLWNFVLDQLWPNGDNQWEEFMKHVEELINQKITEYARDKALAELEGLGNVLELYQEAIEDWKKDPTNVASQERVRTRFRNADAFFENGMPSFRIKNYEVPLLSVYASAANLHLLLLRDASIYGKDWGLNETNVKDNYNRQLKRTESYSNHCVTWYQKGLQRLKGSDADSWLKFNAFRRDMTFTVLDIVVLFPCYDIQKYPMGVKTEITREIYTDPIGNLPRRPGFQVLDWVNHAPSFEEIEKETTGDPSMVTWINYLEISRNKLGGWNSSNDYWEGHSVHYKYSNDGIVIDSKAYAHGDFSGKFPTEAIHLENCDVYASSSLPVAASNPYGDKASFGVTKVYFDMLNLNDNTLQRGSWDHPKNWGGSWVDLKFLNETPNIKEIQKYSHKLTYVSSFSVDYGSVLCYRWRHSSVDRNNTLDPQKITQISAVKGHTPINCEVVRGNGLTDGDWLQLKGGGSFTLNVSSVIPKTYRIRLRYACGPKDVNLTVSCPDNGIDKTITIPSTSTASLANNLMYKDFKYIDLPIEFITSAAPKRCRINLRLEGVQNTSFFMDKFEFIPE

SEQ ID NO: 107 - protein, 613 aa, Artificial sequence
  variant of native sequence
MLRTIQYKNASEIVYDQPLPYGGVVKIAGKIGLGVVKTVITSIIRRGRDNEIAGRILSDVYSVLWSNRKGYWNEMIEAVETLIQQDISENIKNNALAALTDIRNALLLYQQAVEDWESNRTDSQLQERVRNQLISTITFIEFAMPSFTVQHYEVILLPIFTQVANLHLLLLRDAEIFGLKWRMSKAEIDDYYFAKSGLTRLTQKYTNHSVKWYREGLCIATNIDLDQCPEFYQLDKWNAMNDFRREMTFMVLDIIALWPTYDPIRYPLGIKTELTREVFTPLLGINPNSSWLIRTMEEIEAKLTVLSPFLSWISFEQLVKQGDGISTFTDWGNFTLSNTMLPLSYILGGAGPGTGDSTNIPMQSENYDVYKVLVGTDYSHPSNVPIRKLEYYCTNGMMENVITVGTGTTNALFELPNNGCVDYSHRVSRLSCSNVEVYEWEGGPKYALKNIAYGWTHISVDSKNTLSHNAITQIPARKGYSSSESNLSIEGPYFTGGDLIALPPNGAQLQMRVSPPVSSSSINYCVRLRYASSGNTNIYVERVLSSGDTYGETHDVPATYSGGSLSYSSFAYVVNLTAIFEGFNVEIKIKNIGSSQIILDKIEFLPIKESLKE

SEQ ID NO: 108 - protein, 375 aa, Artificial sequence
  variant of native sequence
MSNESKNNENMNLPIINDEDSIPSEIRDSRSKITFPDFNIYKIGTFCGKYVDIPGGANEDSSAIQFQTQDGDNQKFLIFTLDDSYSIIAARHSGKVMDAYYNSSQNRIIQFDFHNTNNQKFFLSDNGTIASKQDRQVWDVQGESTQNGARIVVFKFIDVRNQKFTLNKLGSVPVHQPTLSPLPSAPDFRTNDINEQLPDQTNPVNTHFTYLPYFMVKDPLYNAQQQIKNSPYYTLVRRQYWEKKTQRILAPSDTYEYSETIGVSRTDQSSMTDITEISIGVDLGFVFKGFSAGLSTNVTRTLSVTKSTSNTESSESTRKLSYKNEFRHTIAYAKYMLINEYYVTRANGEKITTGDATYWRVPNPEQTVARIIPRS

SEQ ID NO: 109 - protein, 641 aa, Artificial sequence
  variant of native sequence
MNKNNNEITEVPCSECGDIDYRDIMNMSTQGEYVAQQSVVLTAMNTSFQVIRTLYQANKGTLSKAGGVIKSIFTYLWRQKNSQEEWDNFMKAVEILIAEELSTYARNDAIASVRGLENVLNEYQEALDDLALDPTNSALKDEVKRWVTTVHGQFEATMPTLAVGGYEVQQLVAYAEAANLHLAFLRDVAKFGYQWDLDKTTVANYYKDLKENTQIYTDHCVRTYNTGLEKTKSLMGAINPKDYNKYPYLNPYANGSTNFYKKVLQWNVWNDFRRDMTIMVLDLVALWPTFDPEVYTNPEGVDLELSREVYSTAYGRYGSSTHGGDWKSWEVMETAVDRSPHLVSFLTNLAIYQKTYSSSSTNTKLDQYDGVINTLKTVGSTSTFEDGFAPISKEAYRSVKNIPGEYINGVDLRLGMVPCSLTFKTYSSGTFFAGQCYSHLAQSTFYNLSATIAYHRLSYVNAIDDNFSGYYSGWGIGTWGMGWLHENLKTLNIIHATKSSCIPAVKARILTNSATVIKGPGSTGGDLVKLPGVPSTSDIQVRMNMTREVWKNYRIRIRYATSSSAQLFVGKWTGRWAATANINLAATYSGELTYSAFKLADVPFNITTGEPEFSFELRNNSGGPILIDRIEFIPLEGTFAE

SEQ ID NO: 110 - protein, 635 aa, Artificial sequence
  variant of native sequence
MNKNNNEITEVPCSECGDIDYRDIMNMSTQGEYVAQQSVVLTAMNTSFQVIRTLYQANKGTLSKAGGVIKSIFTYLWRQKNSQEEWDNFMKAVEILIAEELSTYARNDAIASVRGLENVLNEYQEALDDLALDPTNSALKDEVKRWVTTVHGQFEATMPTLAVGGYEVQQLVAYAEAANLHLAFLRDVAKFGYQWDLDKTTVANYYKDLKENTQIYTDHCVRTYNTGLEKTKSLMGAINPKDYNKYPYLNPYANGSTNFYKKVLQWNVWNDFRRDMTIMVLDLVALWPTFDPEVYTNPEGVDLELSREVYSTAYGRYGSSTHGGDWKSWEVMETAVDRSPHLVSFLTNLAIYQKTYSSSSTNTKLDQYDGVINTLKTVGSTSTFEDGFAPISKEAYRSVKNIPGEYINGVDLRLGMVPCSLTFKTYSSGTFFAGQCYSHLAQSTFYNLSATIAYHRLSYVNAIDDNFSGYYSGWGIGTWGMGWLHENLKTLNIIHATKSSCIPAVKARILTNSATVIKGPGSTGGDLVKLPGVPSTSDIQVRMNMTREVWKNYRIRIRYATSSSAQLFVGKWTGRWAATANINLAATYSGELTYSAFKLADVPFNITTGEPEFSFELRNNSGGPILIDRIEFIPL

SEQ ID NO: 111 - protein, 847 aa, Artificial sequence
  variant of native sequence
MAQLQELQIQPVIPYNVLASPPMGNVDDLPTLAEELKQAWESFQKTGNLNFTAFQQGLAAAGGGSFNYLALLQAAIGLAGTVGAEIPGVAIAAPLVSILLGFLWPNKQKSDIKQLITVIDAEVKRILNQELTDYHSQEVQGYLEGFFDTMTNPATSPDIKINESIFTGMPGDPNRTPKDVDATAYDAVVDRFLTANVSFIIDLDQFLTGKFGTNNDVNFDVASLPYYVIGATLQLMSYHSVINFMTAWFPKIWPQYTTEDSRYKDILNAKQAMRMAIRDNTNKVLTIVQANLPSLGSTRNSLNDYNRYARTMQLTCLDTVAQWPTLYPDDYPVSTTLEQTRRIFLDTAGIDERKDSNGKYTNDSTITALYNILDGNSYNSHNNVGINGINSLLYSQDELKSITYRMTYTNNNDYGQYPCFPYGVVLGYTNNQYPSNPAYGNGGDPNNGSYIDSPNTSAPFHTVDAATQNTMYIDAQNMFTDSNPTGCNILNYGGPNGGKSNNPTLATQKIDTLFPFTINNPPGSTKNGLGRLGVMASLVPYNLSPNNVFGEFDSDTQAIIAKGFPAEKGYIDNGSPVSVVKEWVNGANAVQLPAWNTFKITATNLAAGQYRIRVRYANPGPDLLLHQYVYAGDNEVQGGAWTFKSTTDSNVNTNFPNQVYVTGQQGNYVLEDITWPMGGGPSDPLTLPAGDVTVQLFLGDFSQQGQMTQVFIDRIEFVPVGATFPSTIPISVNAQYNQGSVLLWQAPSSSYFIYNFDITGTLYGSQFTSVFFDLENPQGSSGIVPGINQSITLNPNGTDISYKNLTANLNSHGGFNLMRMEGAGSEDFGSNITGNLTITIHKDSTNS

SEQ ID NO: 112 - protein, 720 aa, Artificial sequence
  variant of native sequence
MAQLQELQIQPVIPYNVLASPPMGNVDDLPTLAEELKQAWESFQKTGNLNFTAFQQGLAAAGGGSFNYLALLQAAIGLAGTVGAEIPGVAIAAPLVSILLGFLWPNKQKSDIKQLITVIDAEVKRILNQELTDYHSQEVQGYLEGFFDTMTNPATSPDIKINESIFTGMPGDPNRTPKDVDATAYDAVVDRFLTANVSFIIDLDQFLTGKFGTNNDVNFDVASLPYYVIGATLQLMSYHSVINFMTAWFPKIWPQYTTEDSRYKDILNAKQAMRMAIRDNTNKVLTIVQANLPSLGSTRNSLNDYNRYARTMQLTCLDTVAQWPTLYPDDYPVSTTLEQTRRIFLDTAGIDERKDSNGKYTNDSTITALYNILDGNSYNSHNNVGINGINSLLYSQDELKSITYRMTYTNNNDYGQYPCFPYGVVLGYTNNQYPSNPAYGNGGDPNNGSYIDSPNTSAPFHTVDAATQNTMYIDAQNMFTDSNPTGCNILNYGGPNGGKSNNPTLATQKIDTLFPFTINNPPGSTKNGLGRLGVMASLVPYNLSPNNVFGEFDSDTQAIIAKGFPAEKGYIDNGSPVSVVKEWVNGANAVQLPAWNTFKITATNLAAGQYRIRVRYANPGPDLLLHQYVYAGDNEVQGGAWTFKSTTDSNVNTNFPNQVYVTGQQGNYVLEDITWPMGGGPSDPLTLPAGDVTVQLFLGDFSQQGQMTQVFIDRIEFVPV

SEQ ID NO: 113 - protein, 960 aa, Artificial sequence
  variant of native sequence
MQMVTKAMTPKLGALPDFIDDFNGIFGFMGNITDVMSTIFGVDTGDSSIDDVLNNQELLQEMQAQMQQIQESIKDMTDKEIITQSIEEQILALTKDLSTSITTEFEKIGNILTTYLQAMSGMLKDIYSQTSVIDQKVDKLLAMMTFALKELDYIKDNVVLNSSIVEITPHVQKLVYVNKKFLSLTRGFLQGEDLSIDSMQEIQEWAKSILATEMNSFEFSVDTLHSIIIGDNLYKRSALKTFSDVLLDDADQYGNFGTPLAKFYTFFSSLATLQINAYLCLTFARKVLGLSEIDYQLIMQDRIEQQNQLFVNLIQDKNYSNVLEIKGVYPMPHNNEDGNSFSLQAKKGYALIGLEFFMDNGIYKAKAYQGKIGKNFSVYADTVEEIISDDLSKVFLNNTKDFEQSYKYPLFGELKGEPNTLITRIGFGTKYDESKERQAVAYIDADFSPYEPKSGSISTEGTQTFQIEETKNYTYCYDAWPIGIIGDLYMTPLKSLSLHVDGDSRKNLYMSGESYFSTILSREYNTNFILFPYTNNSSPIVENLIQNGDFEDGDKYWEVSGDTAVIAKGEGIYGSNAISIKNTGDAFEPALKQELNLKPYTKYKLTAYVKSKTNDSQAGLIAIKYTNYMIAFISKTFSTSYKQIELKFRTGADTQNFYVTFEKSNTGYLLLDNIKLHEIPQTDNLIDCGDFGGYDYTTKIDCQYYEPYLWELDGGGSISNGFEEGLFGTDCLKIIKSGGANQKVQLKANTNYILTAYVKVDDPTTTAHIGCGSNQVTCNSTSYTLVKVKFKTGDDPSTTESSVYCSNPNDSGTIWADNFVLCEVPNLIVNGDFEQMDLSSWSLSPSERGTIYIGIGKGISNSNAIVLQDHNGKISQKLPLKPITKYRLTAYVSVTGGGTAQIGYGDDSASCTSNKFQQISTDFTTGADPLQSDDVIYLSTDGCTYTIADNFELYELDQIE

SEQ ID NO: 114 - protein, 959 aa, Artificial sequence
  variant of native sequence
MNNTIVPYNVLRDNDMSNISGTSWDKDQISKGMENSSILLELIEKGLNDGNDILSLLGFIGMKAIEAIPVVGGTISSLISLILFPLKSKVDYQEIWNQLKKSIEKMVDQKIEEAMMSQLMQEIAGLAAILEQYRAAYDLYNGKKVFNIPDGMTPGDHLNTVFVSANMQFIQRMKIFQNPKYKVDLLPFFVHAAEMHILLVRDAAIYGLEWGMDEAVNQYYKMELKRLINEYSKYVLDTYQKGLKEVTERELEDNDFPTTWQKDNYKNTVRWNVINKYKRGMSLTVFDFAYKWKYYHESYQKNLMLNPTRTIYSDIEGSVYPYTKETSEIDNDINFTNLEYRGILKEVQVNNADRIDSLQSIFIRENQKFENRKTGGSGGRGTFVNIESPKNNPLTRVETWSELVPFALKFGFYNGEETRLMGQKTYGKKYTIYQYSGNKVVSIMGFGLNATSGFDSLDAMVVGFKQDDYIPENKIVPINTNGEPLIQVVEVGNFYEGKFESNLKMIEEPMFGDGVLQFENHSNNLNQDNYVTYQIHAEIEGTYELNAIIGANKQKDRIAFKMSLNGEQPENFITESFDDGDIWEGMSLNEELVYKKNSLGNFQLNKGVNNITIYNGALQASANIKIWNLATIELTINADSLKDPDITTLYDQDNYTGTKKLIFEDTNRLEDFNDKASSIKAESHIAGIRFYQNYDYTGDFIDLVGGEKISLKNHLFNNRASSVKFANIVLYNKDNYEGSRKFVFEDIPELTDFNDQTSSIVISSNVSGARLYEHANYEGNYVDVVGGQRLSLKNHVLNKEITSIKFFKGDDEILNGIYQIVPAINNTSVIVNLESSAFVWLWGKDSEFAHQWRVEYDESELAYQIKNMSNENIVLAAMIVTEPSYAHGIPNMKNSLQYWIFEYVGNGYYIIKLKANPKLVLDVNGGNPNDGTIIKVNYSHDLNSPNINAQKFRFNNMNN

SEQ ID NO: 115 - protein, 1391 aa, Artificial sequence
  variant of native sequence
MNQYYNNNEYEILDNGGRGYQPRYPLAQAPGSEFQQMNYKDWMDRYTGEEQAGGLIRAEIDANTALTATFGVAWAVLGVSNPVGSAIAGILNVVTPIIFNQVDPNSPLKVWESMIGYAQALIKKELTETVRNLALDHIDRINDYQIDYKNKARIWEGNPTPGNASQLLDAFKNLKKSCQDAMPHLDTRGYETILLPLYAQAANIHLIVLRDGLMHGRSWGMTNEEYEDLYSGFFGFKNRIATYTNYCTNTFNQGATTNYTADMEDCAKYPWVRYNQDEFYSGFFGPENSCRQSQTTNAYPQPKSGFNQPLNLRNSRQSPGEYRDVEAWNLRNEFISSMTIQVLDTVALWPTYDPRVYTSAVKTEFTREIYTSIRGTTYRSDPAQNTMSAIEARMIRPPHLFEWPQTMTFFFEDVNVRYTWVGNSWTKGQALIGLKTESARTLDTNMITALQGLTDEYEYYHIPLDVSTRQKDITNIRTKQWFEPREFIFYRSGGQQVLALGTIEEDIPGYSVYLVNDYIYTPSIRQNTFPPIEVPEGTPPPSHRLSWVKFEPVRDNATTFVDPKQIGATIFGWTHTSVDPNNTIDATKITQIPAVKASGGTDYQVIKGPGSTGGDLVSLPTYAKIEIPLTSSADQLYEVRIRYAAAEQKRIRIGKKSRDFQWRYIDYDVPSTPYSGGNLTYNAFSYKELGTVQGVLELSIERIDPFDEPIIIDKIEFIPIQGSVETYEADQDLEKARKAVNALFTSDAKNALQLEVTDYLVDQAAKLVECMSDEIYPQEKMCLLDQVKVAKRLSQARNLLHHGDFESPDWFGENGWKTSNHVSVTSGNPIFKGRYLNMPGADNPQLSDTVFPTYAYQKIDESKLKPYTRYMIRGFVGNSKDLEVFITRYDKEVHKNMNVPHDILPTDPCTGTYPLGEGPMLTNHTIPQDMSCDPCDAGTVMKVQQTLVKCEAPHAFTFHIDTGELNRDQNLGIWVGFKIGTTDGRATFDNLEVIEANPLTGEALARVKKREHKWKQKWMEKRTKIDKAVQIAQGAIQALFTDSNQNRLKPDITLNHILQVETEVQKIPYVYNAFLQGALPPVPGETYDIFQQLSSAVAIARSLYEQRNVLRNGDFMAGLSNWRGAKGAIVQKIGNASVLVISDWSANLSQDVPVNPGHGYILRVTAKKEGSGEGYVTISDGTEDNTETLKFTVGEVATRLAQSDMHSPMQGRYQERNMTNAPSEAYGTNGYTSHTMTNYPSDNDGTNAYPGNHNRNYQSESFGITPYGDETSMMNGPSNKYEMNAYAGSTYMTNNGVGCSCGCSTNAYAGENMMRNDSSNENGVGYGCGCRTHPNNRTDSYPMTAHGSSLSGYVTKTFEIFPETNRVCIEIGETSGTFKVESIELIRMDCE

SEQ ID NO: 116 - protein, 720 aa, Artificial sequence
  variant of native sequence
MNQYYNNNEYEILDNGGRGYQPRYPLAQAPGSEFQQMNYKDWMDRYTGEEQAGGLIRAEIDANTALTATFGVAWAVLGVSNPVGSAIAGILNVVTPIIFNQVDPNSPLKVWESMIGYAQALIKKELTETVRNLALDHIDRINDYQIDYKNKARIWEGNPTPGNASQLLDAFKNLKKSCQDAMPHLDTRGYETILLPLYAQAANIHLIVLRDGLMHGRSWGMTNEEYEDLYSGFFGFKNRIATYTNYCTNTFNQGATTNYTADMEDCAKYPWVRYNQDEFYSGFFGPENSCRQSQTTNAYPQPKSGFNQPLNLRNSRQSPGEYRDVEAWNLRNEFISSMTIQVLDTVALWPTYDPRVYTSAVKTEFTREIYTSIRGTTYRSDPAQNTMSAIEARMIRPPHLFEWPQTMTFFFEDVNVRYTWVGNSWTKGQALIGLKTESARTLDTNMITALQGLTDEYEYYHIPLDVSTRQKDITNIRTKQWFEPREFIFYRSGGQQVLALGTIEEDIPGYSVYLVNDYIYTPSIRQNTFPPIEVPEGTPPPSHRLSWVKFEPVRDNATTFVDPKQIGATIFGWTHTSVDPNNTIDATKITQIPAVKASGGTDYQVIKGPGSTGGDLVSLPTYAKIEIPLTSSADQLYEVRIRYAAAEQKRIRIGKKSRDFQWRYIDYDVPSTPYSGGNLTYNAFSYKELGTVQGVLELSIERIDPFDEPIIIDKIEFIPI

SEQ ID NO: 117 - protein, 864 aa, Artificial sequence
  variant of native sequence
MPNEMNSKNNMNTTRIDDKDLLDSKGRECQPRYPSAEAPDVMNPIEKIYTRGQSANISNATSTTIDVTSQILRGSKKLAGLIIKVLIKILWPKGTQQEWENFMDAVEQLIHEKLDTYARNKATADLEGLQRVLSEYIDKLTIYTDDPNAAHAQSLRTQVITTDNLFEYSMPSFAIRDYEMQLLTVYAQAANLHLAFLEDIVRFGDEWGFTPAEIADFHKSMKERTDEYTNHCVSTYNKGLEKAKLLTADLCNHSTYPWTRYNQGWRKEETPNCSLQQIDSCEQPLNESDEQGTPYMGPERRSIDEYQKLENWNLYNAYRRDMTLMVLDIVSLWPTYDPKLYPTSYGVTSELTRELYTDIRGTTYRSDESQNSLDAIEGRMIPQPSLFRWLFGISIKMNQFIGTGGSDDWTSGNLMLGMRIMWRKTLTEQWEGLYFGGGGNLYINLNPLDYAEGITHVNTRQWFEPRWFEFYSGGYDTELKFQNKCGTIEEKSPFWAAGPYNYIYQPGVRTSQIPEHRLSWMTYEPVRENAPFVYPQYKQLGAVALGWTSNSVDQKNAIDLDKITSLPAVKGNEIRGPGSVVRGPGSTGGNLVLLNPTGEVSITVSQPILNKPGAGYYHVRIRYAAIANGKLNVKRSVNSSTQESVTYDYKQTTARDLTYSSFQYLEVYDFNPVTTASQFEVLLTNESGGPIYIDKIEFIPFQGTTGPEAPGIPADIYYTISPAIDENYYTIGGSTIWLSLKESFSNPPRDGQWRFVYDTNKKAYQIGTQLNEDPAGGLFAVLTSTEPNNNLTMYPNLSLDQQYWFVKDAGDGYVTLENYGYPGYVVNVPRVYQGAILTLSPFIGSMNHKFKLTKLSTNDEVILG

SEQ ID NO: 118 - protein, 701 aa, Artificial sequence
  variant of native sequence
MPNEMNSKNNMNTTRIDDKDLLDSKGRECQPRYPSAEAPDVMNPIEKIYTRGQSANISNATSTTIDVTSQILRGSKKLAGLIIKVLIKILWPKGTQQEWENFMDAVEQLIHEKLDTYARNKATADLEGLQRVLSEYIDKLTIYTDDPNAAHAQSLRTQVITTDNLFEYSMPSFAIRDYEMQLLTVYAQAANLHLAFLEDIVRFGDEWGFTPAEIADFHKSMKERTDEYTNHCVSTYNKGLEKAKLLTADLCNHSTYPWTRYNQGWRKEETPNCSLQQIDSCEQPLNESDEQGTPYMGPERRSIDEYQKLENWNLYNAYRRDMTLMVLDIVSLWPTYDPKLYPTSYGVTSELTRELYTDIRGTTYRSDESQNSLDAIEGRMIPQPSLFRWLFGISIKMNQFIGTGGSDDWTSGNLMLGMRIMWRKTLTEQWEGLYFGGGGNLYINLNPLDYAEGITHVNTRQWFEPRWFEFYSGGYDTELKFQNKCGTIEEKSPFWAAGPYNYIYQPGVRTSQIPEHRLSWMTYEPVRENAPFVYPQYKQLGAVALGWTSNSVDQKNAIDLDKITSLPAVKGNEIRGPGSVVRGPGSTGGNLVLLNPTGEVSITVSQPILNKPGAGYYHVRIRYAAIANGKLNVKRSVNSSTQESVTYDYKQTTARDLTYSSFQYLEVYDFNPVTTASQFEVLLTNESGGPIYIDKIEFIPF

SEQ ID NO: 119 - protein, 1195 aa, Artificial sequence
  variant of native sequence
MNHNNNNNEYEIIDSHTSSYPSNRNSNHSRYPYTNNPNQPLSNTNYKDWLTMCQGNQPYRDKPQTLVDTGVAISTGLIIIGTIMTGFPALTPWGIGIVSFGTLLPVLWPSGETDKKVWIDFMNYGGTIFKPLLNEQKDQAQRILQGFHLPINSYQNGITTWQNLRKSHIPGTPPSSALREAARVARTRIDIANSALSRISEIQSAQFGAAILPFYAQAATLHLNLLSQAVQFADQLKADAENQPTQDAGTSDEYHRLLKQYTQQYTDYCVKTYQEGLTTLKNAPDMTWNIYNTYRRDMTLLVLDYIALFPNFDIRQYPTGTHSELTREIYTDALIKEQPNPPIPIPVAQRETELTRPPHLFSRLNRLLLFSNTDPSPPALSAVQNSFTYTNNNIVQYSQIYRLINSPEPTGSTQQIIISNTDIYRIELTLRQNYFITHNINFYTLDGITRRYNSGSTPETPIIINFQLPEFPADKIPPYGLGTKYSHILSYMKISPNRHNIVLPNERHLSFAWTHTSVNFDNEISNQIVTQIPAVKARSLDTSSSVISGPGHTGGDLVLFRSRMEFQCFVPTQTKYKIRMRYVAYSPNNSISLTLNIMGQVNYGLRALNIKSTVASEKDTVNPKYNDFQYLYFYTQDPNEIAIVNLYSLTNMTLQSNNFAGNTLVIDKIEFLPVTQTLEENLETQKLEEIQQTVNTFFTNHTKNILNIETTDYEIDQTAILVESLSEEQYPQEKMILLDTMKQAKQFSQSRNLLQNGDFSSFIGWTINNDLTLQTNNPIFKGQYLHILGARTTEIDNTIFPTYVYQKIDESKLKPYTRYVVRGCISNSKDLELFVTRYNKEIHKILNIPNDSSHMNAEIQTNSYEAQSYSFRNENNNLTNQQSPYPTTSNHSGYSESTLISSNFENENAFSFSIDTGNLDFNENLGIGILFKISNPDGYAALGNLEVIEEQPLTEEEVNRVTEKENRWKQVRNNQQKETEQAYYQAQQAIDALFINSQHQMLKIETTIQDIVVAETFIDKIPYIYNEWLPNEPGMNYTLYQGLKQQISQAYMLYRNRNLIQNGNFINSTTNWFTSPDAKIQQIDNTSILVIPNWSTQVSQNINLPQQNHQYLLRVIAKKEGIGNGYVKISDCTKHVETLIFTSCDYNNNAMWNEPMGYVTKTMHITPHTNQVRIDIGETEGTFKINSVELIGIKN

SEQ ID NO: 120 - protein, 674 aa, Artificial sequence
  variant of native sequence
MNHNNNNNEYEIIDSHTSSYPSNRNSNHSRYPYTNNPNQPLSNTNYKDWLTMCQGNQPYRDKPQTLVDTGVAISTGLIIIGTIMTGFPALTPWGIGIVSFGTLLPVLWPSGETDKKVWIDFMNYGGTIFKPLLNEQKDQAQRILQGFHLPINSYQNGITTWQNLRKSHIPGTPPSSALREAARVARTRIDIANSALSRISEIQSAQFGAAILPFYAQAATLHLNLLSQAVQFADQLKADAENQPTQDAGTSDEYHRLLKQYTQQYTDYCVKTYQEGLTTLKNAPDMTWNIYNTYRRDMTLLVLDYIALFPNFDIRQYPTGTHSELTREIYTDALIKEQPNPPIPIPVAQRETELTRPPHLFSRLNRLLLFSNTDPSPPALSAVQNSFTYTNNNIVQYSQIYRLINSPEPTGSTQQIIISNTDIYRIELTLRQNYFITHNINFYTLDGITRRYNSGSTPETPIIINFQLPEFPADKIPPYGLGTKYSHILSYMKISPNRHNIVLPNERHLSFAWTHTSVNFDNEISNQIVTQIPAVKARSLDTSSSVISGPGHTGGDLVLFRSRMEFQCFVPTQTKYKIRMRYVAYSPNNSISLTLNIMGQVNYGLRALNIKSTVASEKDTVNPKYNDFQYLYFYTQDPNEIAIVNLYSLTNMTLQSNNFAGNTLVIDKIEFLPV

SEQ ID NO: 121 - protein, 654 aa, Artificial sequence
  variant of native sequence
MNSYQNTNEYEILDGSPNNTNMSNRYPFAKDPNIFPINLDACQGRPWQDTWESVSDIVTIGTYLIQFLLEPGIGGIPVILSIINKLIPSSGQSVAALSICDLLSIIRKEVDESVLSDGVADFKGEMTAYRDYYLPYLEDWLTDKSNPEKLADVVKQFQAREEDFTKLLAGSLSRQKAEILLLPTYVQAANVHLLLLRDAVKYKKEWGLVCPPLYPGSGRTDCNERLKAKIKEYTNYCVEWYNKGLDQIKQAGTSTETWLKFNKFRREMTLAVLDVIAIFPTYDFEKYPLATNVELTREVYTDPVGYSGSSIRWERTFPNAFNTLEANGTRGPGLVTWLEVLGIYNHDFQDITVYFSGWVGSRHSEDYTRGNGTFSRISGTTSNDIRNQTFYSRDVFKIDSLGIYETRAELGYTRQRFCVSRAVFSSTLYNYVYDARNNGQGRMTIESMLPGIKNPIPSSQDYSHRLSNAACVQFNDSRINVYGWTHTSMTKNNPIYTDKISQIPAVKAFALESGAYVSRGPGHTGGDVVTLPNRGRLKIRLTSAPTNKNYRVRVRYATSYGADLMVQRWSPSGNHASGYFSGSPTGSYPTFGYMNTLVTTFNQSGVEIIIENRHYSNIIIDKIEFIPDDITTLEYEGERDLEKTKNAVNDLFTN

SEQ ID NO: 122 - protein, 628 aa, Artificial sequence
  variant of native sequence
MNSYQNTNEYEILDGSPNNTNMSNRYPFAKDPNIFPINLDACQGRPWQDTWESVSDIVTIGTYLIQFLLEPGIGGIPVILSIINKLIPSSGQSVAALSICDLLSIIRKEVDESVLSDGVADFKGEMTAYRDYYLPYLEDWLTDKSNPEKLADVVKQFQAREEDFTKLLAGSLSRQKAEILLLPTYVQAANVHLLLLRDAVKYKKEWGLVCPPLYPGSGRTDCNERLKAKIKEYTNYCVEWYNKGLDQIKQAGTSTETWLKFNKFRREMTLAVLDVIAIFPTYDFEKYPLATNVELTREVYTDPVGYSGSSIRWERTFPNAFNTLEANGTRGPGLVTWLEVLGIYNHDFQDITVYFSGWVGSRHSEDYTRGNGTFSRISGTTSNDIRNQTFYSRDVFKIDSLGIYETRAELGYTRQRFCVSRAVFSSTLYNYVYDARNNGQGRMTIESMLPGIKNPIPSSQDYSHRLSNAACVQFNDSRINVYGWTHTSMTKNNPIYTDKISQIPAVKAFALESGAYVSRGPGHTGGDVVTLPNRGRLKIRLTSAPTNKNYRVRVRYATSYGADLMVQRWSPSGNHASGYFSGSPTGSYPTFGYMNTLVTTFNQSGVEIIIENRHYSNIIIDKIEFIPD

SEQ ID NO: 123 - protein, 317 aa, Unknown
  Unknown organism from environmental sample
MKNKIILYGVVTSTLLAGGPFSNNASASENQGMTGNNIGVVSSNIKAAEQNKNSAYQDIDERVKKMLISAAFDGTEYRYHHIKDTELNGNIIEGSMIENAQILTIGENILENNLGHEVTLFTSGYEHEFKEMTSTTNTSGWTFGYNYNATLSVMMVSASQSFSVDYNMSTSNTTEKSQVRKFTVPPQGFPVPAGKKYKVEYVFEKITISGRNRLNADLYGDATYYYNNLPMSPQLLYSAMNFASDTQGFERVIRDNAEGNDRFGIRATGEGRFSTEFGTRLYAKITDITDSKKPVTIETKKIPVNFETLSVATKIIE

SEQ ID NO: 124 - protein, 291 aa, Artificial sequence
  variant of native sequence
MSENQGMTGNNIGVVSSNIKAAEQNKNSAYQDIDERVKKMLISAAFDGTEYRYHHIKDTELNGNIIEGSMIENAQILTIGENILENNLGHEVTLFTSGYEHEFKEMTSTTNTSGWTFGYNYNATLSVMMVSASQSFSVDYNMSTSNTTEKSQVRKFTVPPQGFPVPAGKKYKVEYVFEKITISGRNRLNADLYGDATYYYNNLPMSPQLLYSAMNFASDTQGFERVIRDNAEGNDRFGIRATGEGRFSTEFGTRLYAKITDITDSKKPVTIETKKIPVNFETLSVATKIIE

SEQ ID NO: 125 - protein, 900 aa, Unknown
  Unknown organism from environmental sample
MDCNLQSQQNIPYNVLAIPVSNVNSLTDTIGDLKKAWEEFQKTGSFSLTALQQGFNAAQGGTFNYLTLLQSGISLAGSFVPGGTFVAPIINMVIGWLWPHKNKNADTENLINLIDSEIQKQLNKALLDQDRQDWISYLESIFDSSNNLNGAIIDAQWSGTVNTTNRTLRNPTESDYLNVVTNFIAADGDISSNEHHIMNGNFDVAAAPYFVIGATARFATMQSYIKFCNAWIDKVGLSDSQLTTQKANLDRTKQTMRNAILSYTQQVMKVFKDPKNMPTIDTNKFSVDTYNVYVKGMTLNVLDIVAIWPSLYPDDYTSQTSLEQTRVTFSNMVGQEEGTDGTVTIYNTFDSDSYRHKAIPNNDVNLLSYFPDELQNVQLALYTPSKKDSGYTYPYAFISNYQYSRYQYGDNAPEGPLSTLSAPIQSINAATQNTKYLDGETINGIGANLPGYCTSDCSPTQQPFSCTSTVNQFKQSCNPTDTNQKINALYAFTQTNVKGNQGKLGLLASHVPYDLNPKNIFGELDPDTNNVILKGIPAEKGYFSNNTRPNIVKEWINGANAVPLDSGNTLFMTATNVTATQYKIRIRYANPNSNTQIGVQISQNGSIISNSNLTLYSTTDMNNTLPLNVYVTGENGNYTLLDLYSTTNVLSTGDITLKLTGGDQKIFIDRIEFVPTMPVPGNTNNNNGDNGNNNPVHHVCAIAGTQQSCSGPPKFEQVSDLEKITTQVYMLFKSSPYEELAPEVSSYQISQVALKVMALSDELFCKEKSLLRKLVNKAKQLLEASNLLVGGNFETTQNWVLGTNAYINYDSFLFNGNYLSLQPASGFFTSYAYQKIDESTLKPYTRYKVSGFIGQSNQVELIISRYGKEIDKILNVPYAGPLPITANALITCCAPENRPM

SEQ ID NO: 126 - protein, 676 aa, Artificial sequence
  variant of native sequence
MDCNLQSQQNIPYNVLAIPVSNVNSLTDTIGDLKKAWEEFQKTGSFSLTALQQGFNAAQGGTFNYLTLLQSGISLAGSFVPGGTFVAPIINMVIGWLWPHKNKNADTENLINLIDSEIQKQLNKALLDQDRQDWISYLESIFDSSNNLNGAIIDAQWSGTVNTTNRTLRNPTESDYLNVVTNFIAADGDISSNEHHIMNGNFDVAAAPYFVIGATARFATMQSYIKFCNAWIDKVGLSDSQLTTQKANLDRTKQTMRNAILSYTQQVMKVFKDPKNMPTIDTNKFSVDTYNVYVKGMTLNVLDIVAIWPSLYPDDYTSQTSLEQTRVTFSNMVGQEEGTDGTVTIYNTFDSDSYRHKAIPNNDVNLLSYFPDELQNVQLALYTPSKKDSGYTYPYAFISNYQYSRYQYGDNAPEGPLSTLSAPIQSINAATQNTKYLDGETINGIGANLPGYCTSDCSPTQQPFSCTSTVNQFKQSCNPTDTNQKINALYAFTQTNVKGNQGKLGLLASHVPYDLNPKNIFGELDPDTNNVILKGIPAEKGYFSNNTRPNIVKEWINGANAVPLDSGNTLFMTATNVTATQYKIRIRYANPNSNTQIGVQISQNGSIISNSNLTLYSTTDMNNTLPLNVYVTGENGNYTLLDLYSTTNVLSTGDITLKLTGGDQKIFIDRIEFVPT

SEQ ID NO: 127 - protein, 662 aa, Unknown
  Unknown organism from environmental sample
MGGLLMNQYYNNNEYEILDNGVQCCSPRYPLAQAPGSEWQNMNYQDVMNTSVGREYQAVQQVNVGEAVGAALGILTTILKAVNPTLGTAAGVISSIFGFLWKRFGTDPQAQWKQFMEAVEYLVSQKITDAVRSKAVSELEGVQRAVELYQEAANAWNMNPDDAAAKERIRRQYTSTNTVIEYAMPSFRVGSFEVPLLTVYAQAANLHLLLLRDAVKFGAGWGFSPTEVEDNYTRLQARTAEYTNHCTNTYDKGLKQAYDLAPNPTDYNKYPYLNPYSKNPIYGKYYTAPVDWNLFNDFRRDMTLMVLDIVAVWPTYNPRLYNNPNGVQIQLSREVYSTVYGRGWSNNSTVDAIESTLVRPPHLVTELTKLTFDERNLYEAETVPVAFRKVTNTLHYVGSSTTWEQSFSATPVGSLKAVHNVLATDIGNLALSLGAVPLGFSFYNKNDQHITTVGYSGGWWNGIPKDEGSNQNSHHLSYVAALETQTTAGWFPTYPVPLLGEWGFGWQHNSLKYTNRLVTNQINQLPAVKASALVNHARVSKGTTGTGGNIIELVNPNCGFIFNFYAEPENPQGQAFNIRIRYSATVPGKLNIRHLESGKEFMNTPRDFKGTTTGTNWIPKFQEYQYLDLGPIVLRTGMNYGFKIELASGQLVSIDKIEFLPF

SEQ ID NO: 128 - protein, 657 aa, Artificial sequence
  variant of native sequence
MNQYYNNNEYEILDNGVQCCSPRYPLAQAPGSEWQNMNYQDVMNTSVGREYQAVQQVNVGEAVGAALGILTTILKAVNPTLGTAAGVISSIFGFLWKRFGTDPQAQWKQFMEAVEYLVSQKITDAVRSKAVSELEGVQRAVELYQEAANAWNMNPDDAAAKERIRRQYTSTNTVIEYAMPSFRVGSFEVPLLTVYAQAANLHLLLLRDAVKFGAGWGFSPTEVEDNYTRLQARTAEYTNHCTNTYDKGLKQAYDLAPNPTDYNKYPYLNPYSKNPIYGKYYTAPVDWNLFNDFRRDMTLMVLDIVAVWPTYNPRLYNNPNGVQIQLSREVYSTVYGRGWSNNSTVDAIESTLVRPPHLVTELTKLTFDERNLYEAETVPVAFRKVTNTLHYVGSSTTWEQSFSATPVGSLKAVHNVLATDIGNLALSLGAVPLGFSFYNKNDQHITTVGYSGGWWNGIPKDEGSNQNSHHLSYVAALETQTTAGWFPTYPVPLLGEWGFGWQHNSLKYTNRLVTNQINQLPAVKASALVNHARVSKGTTGTGGNIIELVNPNCGFIFNFYAEPENPQGQAFNIRIRYSATVPGKLNIRHLESGKEFMNTPRDFKGTTTGTNWIPKFQEYQYLDLGPIVLRTGMNYGFKIELASGQLVSIDKIEFLPF

SEQ ID NO: 129 - protein, 1018 aa, Unknown
  Bacillus sp. obtained from an environmental sample
MNQNYNDEYEIMNTGVMGYQSRYPLAKTPGSEIQQMNYKDWMDMYTHGESGETFISARDGVIIGTGIGWAILGFVPVLGPGLSAISGILNVLLPILWPEDAVTAESQVSWDKLMRTAEEIANKAIDAQVRAEAITELQGIQEAIQLYHGAVCDWKKAPTNVRLQETVRTQFIATNTVIFNRMPSFRVQGFETSLLSTYAQAANLHLAFLRDGVQFGTEWGLDPTTVDRYYGYLTANTASYTNYCVRWYDKGLSDLRTTNNWNKYNNFRRDMTIMAMDLVSLWPTYDPKRYPTFTKSQLTRTVYTPWIGHIKNRWMGHPQEVPFSEIESNLIDIPRLFAWLRELIVYSVDPQRRGYSTLVCGRKQRFQNTLSNNLWDGGMKGSHGEEPPQTLTIPSPQSKDDIWKINTTSTLMAQGPENTQIKGWDFSFTNSQTQTISTIYQGQESLVYAVSGLPCRSSYNLCDPCDPDCKVDILTPGDPCNDKLLYSHRFAYLGAGIDPYMGYPGRAGGYGYYSYGWTHISADANNLIDTEKITQIPAVKASGGTDYQVIRGPGSTGGDLVSLATDARIELKLTASIAKYYQMRIRYASPVQTRLRLETYQDDISGGPVNYDIPSTPYSGNQNELSYNAFGYKHVMNVYISLTGTKISIQRVDPFDYPFIIDKIEFIPIEGSLEAYQADQDLEKARKKVNALFMSDAKDVLKLNVTDYALDQAANLVECLSDEFCAQEKMILLDQVKFAKRLSQSRNLLNYGDFESPYWSGENGWKTSPHIHVASGNPIFKGHYLHMPGANQPQTSGTVYPTYIYQKVDESKLKPYTRYHVRGFVGNSKDLELLVERYGKEIHVEMDVPNDIRYTLPMNECGGFERCSHEPHHTCTCKDTARVDTGCQCQDKMNRMTTGVYTNIPTASEMYPNGYLVHKSCGCKDPHVFSFHIDTGCVDLKENLGLLFAFKISSTDGVANVDNLEIIEGQPLTGEALARVKKREHKWKETMKQKRCKTDEAVQAVQTAINALFTNAQY

SEQ ID NO: 130 - protein, 669 aa, Artificial sequence
  variant of native sequence
MNQNYNDEYEIMNTGVMGYQSRYPLAKTPGSEIQQMNYKDWMDMYTHGESGETFISARDGVIIGTGIGWAILGFVPVLGPGLSAISGILNVLLPILWPEDAVTAESQVSWDKLMRTAEEIANKAIDAQVRAEAITELQGIQEAIQLYHGAVCDWKKAPTNVRLQETVRTQFIATNTVIFNRMPSFRVQGFETSLLSTYAQAANLHLAFLRDGVQFGTEWGLDPTTVDRYYGYLTANTASYTNYCVRWYDKGLSDLRTTNNWNKYNNFRRDMTIMAMDLVSLWPTYDPKRYPTFTKSQLTRTVYTPWIGHIKNRWMGHPQEVPFSEIESNLIDIPRLFAWLRELIVYSVDPQRRGYSTLVCGRKQRFQNTLSNNLWDGGMKGSHGEEPPQTLTIPSPQSKDDIWKINTTSTLMAQGPENTQIKGWDFSFTNSQTQTISTIYQGQESLVYAVSGLPCRSSYNLCDPCDPDCKVDILTPGDPCNDKLLYSHRFAYLGAGIDPYMGYPGRAGGYGYYSYGWTHISADANNLIDTEKITQIPAVKASGGTDYQVIRGPGSTGGDLVSLATDARIELKLTASIAKYYQMRIRYASPVQTRLRLETYQDDISGGPVNYDIPSTPYSGNQNELSYNAFGYKHVMNVYISLTGTKISIQRVDPFDYPFIIDKIEFIPI

SEQ ID NO: 131 - protein, 1018 aa, Unknown
  Bacillus sp. obtained from an environmental sample
MNQNYNDEYEIMNTGVMGYQSRYPLAKTPGSEIQQMNYKDWMDMYTHGESGETFISARDGVIIGTGIGWAILGFVPVLGPGLSAISGILNVLLPILWPEDAVTAESQVSWDKLMRTAEEIANKAIDAQVRAEAITELQGIQEAIQLYHGAVCDWKKAPTNVRLQETVRTQFIATNTVIFNRMPSFRVQGFETSLLSTYAQAANLHLAFLRDGVQFGTEWGLDPTTVDRYYGYLTANTASYTNYCVRWYDKGLSDLRTTNNWNKYNNFRRDMTIMAMDLVSLWPTYDPKRYPTFTKSQLTRTVYTPWIGHIKNRWMGHPQEVPFSEIESNLIDIPRLFAWLRELIVYSVDPQRRGYSTLVCGRKQRFQNTLSNNLWDGGMKGSHGEEPPQTLTIPSPQSKDDIWKINTTSTLMAQGPENTQIKGWDFSFTNSQTQTISTIYQGQESLVYAVSGLPCRSSYNLCDPCDPDCKVDILTPGDPCNDKLLYSHRFAYLGAGIDPYMGYPGRAGGYGYYSYGWTHISADANNLIDTEKITQIPAVKASGGTDYQVIRGPGSTGGDLVSLATDARIELKLTASIAKYYQMRIRYASPVQTRLRLETYQDDISGGPVNYDIPSTPYSGNQNELSYNAFGYKHVMNVYISLTGTKISIQRVDPFDYPFIIDKIEFIPIEGSLEAYQADQDLEKARKKVNALFMSDAKDVLKLNVTDYALDQAANLVECLSDEFCAQEKIILLDQVKFAKRLSQSRNLLNYGDFESPYWSGENGWKTSPHIHVASGNPIFKGHYLHMPGANQPQTSGTVYPTYIYQKVDESKLKPYTRYHVRGFVGNSKDLELLVERYGKEIHVEMDVPNDIRYTLPMNECGGFERCSHEPHHTCTCKDTARVDTGCQCQDKMNRMTTGVYTNIPTASEMYPNGYLVHKSCGCKDPHVFSFHIDTGCVDLKENLGLLFAFKISSTDGVANVDNLEIIEGQPLTGEALARVKKREHKWKETMKQKRCKTDEAVQAVQTAINALFTNAQY

SEQ ID NO: 132 - protein, 641 aa, Unknown
  Bacillus sp. obtained from an environmental sample
MKGRRPMGNMDSKSVMEKKEQKSQYLDIRDICSINGSAKFDPNTNITTLTEAINSQAGAIAGKTAFDMRHDFTLVADIYLGSKSSGADGIAIAFHRGSIGFIGQMGGGLGILGAPNGIGFEIDTYWKASSDETGDSFGHGQMNGPHAGFVSTNRNTSYLTALAPMQRIPAPNSKWRILTINWDARNNKLTARLQEKNNDDTTRSASPRYQTWELLNPAFDLNQKYTFVIGSATGAANNKHQIGVTLFEAYFTKPTIEANPVDIEIGTAFDPLKYELIGLKATDEIDGDITDKITVEFNNVDTSKPGAYRVTYKVLNSYEESDEKIIEVVVYTKPTIAAHDVAIKKDLAFDPLDYEPIELKATDPIDGDITDKITIESNNADTSKPGKYHVTYKVLNSYEKSDEKTIEITVYTKPTLEAYDVEIKKDTVFDPLNYEPIGLKATDPIDGDITDKITVESNNVDTSKPGEYHVTYKVLNSYEESDEKTITVMVPVIDDGWENGDPNGWKFFSGESITLEEDEENALNGKWVFYSDKHVAIYKQVELENNISYQITVYVKPEDEGTVANHIVKVSLKPDPASGESQEILNTRLLGAEQIQKGYRKLTSNPFIPTTIEPYKKPIIVIENFLVGWIGGIKIIVEPTK

SEQ ID NO: 133 - protein, 632 aa, Artificial sequence
  variant of native sequence
MDSKSVMEKKEQKSQYLDIRDICSINGSAKFDPNTNITTLTEAINSQAGAIAGKTAFDMRHDFTLVADIYLGSKSSGADGIAIAFHRGSIGFIGQMGGGLGILGAPNGIGFEIDTYWKASSDETGDSFGHGQMNGPHAGFVSTNRNTSYLTALAPMQRIPAPNSKWRILTINWDARNNKLTARLQEKNNDDTTRSASPRYQTWELLNPAFDLNQKYTFVIGSATGAANNKHQIGVTLFEAYFTKPTIEANPVDIEIGTAFDPLKYELIGLKATDEIDGDITDKITVEFNNVDTSKPGAYRVTYKVLNSYEESDEKIIEVVVYTKPTIAAHDVAIKKDLAFDPLDYEPIELKATDPIDGDITDKITIESNNADTSKPGKYHVTYKVLNSYEKSDEKTIEITVYTKPTLEAYDVEIKKDTVFDPLNYEPIGLKATDPIDGDITDKITVESNNVDTSKPGEYHVTYKVLNSYEESDEKTITVMVPVIDDGWENGDPNGWKFFSGESITLEEDEENALNGKWVFYSDKHVAIYKQVELENNISYQITVYVKPEDEGTVANHIVKVSLKPDPASGESQEILNTRLLGAEQIQKGYRKLTSNPFIPTTIEPYKKPIIVIENFLVGWIGGIKIIVEPTK

SEQ ID NO: 134 - protein, 632 aa, Unknown
  Bacillus sp. obtained from an environmental sample
LNSKSIIENEVQENQYIDIRNICSINGSAKFDPNTNITTLTEAINSQAGAIAGKTALDMRRDFTLVADIYLGSKSSGADGIAIAFHRGSIGFIGTMGGGLGILGAPNGIGFEIDTYWKASSDETGDSFGHGQMNGPHAGFVSTNRNASYLTALAPMQRIAPPNGQWRVLTIKWDARDNKLTASLQEKNNDASTRSATPRYQTWELLNPAFDLNQKYTFVIGSATGAANNKHQIGVTLFEAYFTKPTIVANPVDIEIGTAFDPLNYEPIGLKATDEVDGDITKDITVEFNDVDTSKPGAYRVTYKVVNSYGESDEKTIEVVVYTKPTITAHDVAIKKGLAFDPLNYEPIGLKATDPIDGDITDKITVKFNNVDTSKPGKYHVTYKVINSYEKIDEKTIEITVYTKPTIVAQDVKIKKDTAFDPLNYEPIGLKATDPIDGDITDKITVEFNDVDTSKPGAYSVRYKVVNNYEESDEKTIAVTVPVIDDGWENGDPTGWKFFSGETITLEEDEENALNGKWVFYADKHVAIYKQVELKNNTPYQITVYVKPEDEETVAHHIVKVSFKSDSAGQESEEIINERLIDAEQIQKGYRKLTSIPFTPTTIVPNKKPVIIVENFLPGWIGGVRIIVEPTK

SEQ ID NO: 135 - protein, 632 aa, Artificial sequence
  variant of native sequence
MNSKSIIENEVQENQYIDIRNICSINGSAKFDPNTNITTLTEAINSQAGAIAGKTALDMRRDFTLVADIYLGSKSSGADGIAIAFHRGSIGFIGTMGGGLGILGAPNGIGFEIDTYWKASSDETGDSFGHGQMNGPHAGFVSTNRNASYLTALAPMQRIAPPNGQWRVLTIKWDARDNKLTASLQEKNNDASTRSATPRYQTWELLNPAFDLNQKYTFVIGSATGAANNKHQIGVTLFEAYFTKPTIVANPVDIEIGTAFDPLNYEPIGLKATDEVDGDITKDITVEFNDVDTSKPGAYRVTYKVVNSYGESDEKTIEVVVYTKPTITAHDVAIKKGLAFDPLNYEPIGLKATDPIDGDITDKITVKFNNVDTSKPGKYHVTYKVINSYEKIDEKTIEITVYTKPTIVAQDVKIKKDTAFDPLNYEPIGLKATDPIDGDITDKITVEFNDVDTSKPGAYSVRYKVVNNYEESDEKTIAVTVPVIDDGWENGDPTGWKFFSGETITLEEDEENALNGKWVFYADKHVAIYKQVELKNNTPYQITVYVKPEDEETVAHHIVKVSFKSDSAGQESEEIINERLIDAEQIQKGYRKLTSIPFTPTTIVPNKKPVIIVENFLPGWIGGVRIIVEPTK

SEQ ID NO: 136 - protein, 632 aa, Unknown
  Bacillus sp. obtained from an environmental sample
LNSKSIIENEVQENQYIDIRNICSINGSAKFDPNTNITTLTEAINSQAGAIAGKTALDMRRDFTLVADIYLGSKSSGADGIAIAFHRGSIGFIGTMGGGLGILGAPSGIGFEIDTYWKASSDETGDSFGHGQMNGPHAGFVSTNRNASYLTALAPMQRIAPPNGQWRVLTIKWDARDNKLTASLQEKNNDASTRSATPRYQTWELLNPAFDLNQKYTFVIGSATGAANNKHQIGVTLFEAYFTKPTIVANPVDIEIGTAFDPLNYEPIGLKATDEVDGDITKDITVEFNDVDTSKPGAYRVTYKVVNSYGESDEKTIEVVVYTKPTITAHDVAIKKGLAFDPLNYEPIGLKATDPIDGDITDKITVKFNNVDTSKPGKYHVTYKVINSYEKIDEKTIEITVYTKPTIVAQDVKIKKDTAFDPLNYEPIGLKATDPIDGDITDKITVEFNDVDTSKPGAYSVRYKVVNNYEESDEKTIAVTVPVIDDGWENGDPTGWKFFSGETITLEEDEENALNGKWVFYADKHVAIYKQVELKNNTPYQITVYVKPEDEETVAHHIVKVSFKSDSAGQESEEIINERLIDAEQIQKGYRKLTSIPFTPTTIVPNKKPVIIVENFLPGWIGGVRIIVEPTK

SEQ ID NO: 137 - protein, 632 aa, Artificial sequence
  variant of native sequence
MNSKSIIENEVQENQYIDIRNICSINGSAKFDPNTNITTLTEAINSQAGAIAGKTALDMRRDFTLVADIYLGSKSSGADGIAIAFHRGSIGFIGTMGGGLGILGAPSGIGFEIDTYWKASSDETGDSFGHGQMNGPHAGFVSTNRNASYLTALAPMQRIAPPNGQWRVLTIKWDARDNKLTASLQEKNNDASTRSATPRYQTWELLNPAFDLNQKYTFVIGSATGAANNKHQIGVTLFEAYFTKPTIVANPVDIEIGTAFDPLNYEPIGLKATDEVDGDITKDITVEFNDVDTSKPGAYRVTYKVVNSYGESDEKTIEVVVYTKPTITAHDVAIKKGLAFDPLNYEPIGLKATDPIDGDITDKITVKFNNVDTSKPGKYHVTYKVINSYEKIDEKTIEITVYTKPTIVAQDVKIKKDTAFDPLNYEPIGLKATDPIDGDITDKITVEFNDVDTSKPGAYSVRYKVVNNYEESDEKTIAVTVPVIDDGWENGDPTGWKFFSGETITLEEDEENALNGKWVFYADKHVAIYKQVELKNNTPYQITVYVKPEDEETVAHHIVKVSFKSDSAGQESEEIINERLIDAEQIQKGYRKLTSIPFTPTTIVPNKKPVIIVENFLPGWIGGVRIIVEPTK

SEQ ID NO: 138 - protein, 632 aa, Unknown
  Bacillus sp. obtained from an environmental sample
MNSKSTIEKEVQKSQYLDIRNICSINGSAKFDPNTNITTLTEAINSQAGAIAGKTALDMRHDFTLVADIYLGSKSSGADGIAIAFHRGSIGFIGNMGGGLGILGAPNGIGFEIDTYWKASSDETGDSFGHGQMNGPHAGFVSTNRNASYLTALAPMQRISTPNGKWRVLTINWDARNNKLTARLQEKNNDASTSSASPRYQTWELLNPAFDLNQKYTFVIGSATGAANNKHQIGVTLFEAYFTKPTIEANPVDIEAGTAFDPLNYEPIGLKATDEIDGDITDKITVEFNDVDTSKPGAYRVTYKVVNSYEESDEKTIEVIVYTKPTITAHDVIIKKDLAFDPLNYEPIGLKATDPIDGDITDKVTVESNNVDTSKPGKYHVAYKVVNSYEKSDEKTIEVVVYTKPTLEAHDVEVKKDTVFDPLNYEPIGLKATDPIDGDITDKITVESDNVDTSKPGEYHVTYKVVNSYEESDEKSILVTVPVIDDGWENGDPKGWKFFSGESITLDEDEENALNGKWVFYSDKHVAIYKQVELENNTTYQITVYVKPEDEGTVAHHIVKASLKPNPSGPDSEELLNERLINGEQIQKGYRKLTSIPFTPTTIEPYKKPLIVIENYLAGWIGGIKIIVEPTK

SEQ ID NO: 139 - protein, 632 aa, Unknown
  Bacillus sp. obtained from an environmental sample
MNSKSIIENEVQENQYIDIRNICSINGSAKFDPNTNITTLTEAINSQAGAIAGKTALDMRRDFTLVADIYLGSKSSGADGIAIAFHRGSIGFIGTMGGGLGILGAPNGIGFEIDTYWKASSDETGDSFGHGQMNGPHAGFVSTDRKASYLTALAPMQRIAPPNGQWRVLTIKWDARDNKLTASLQEKNNDASTRSATPRYQTWELLNPAFDLNQKYTFVIGSATGAANNKHQIGVTLFEAYFTKPTIVANPVDIEIGTAFDPLNYEPIGLKATDEVDGDITKDITVEFNDVDTSKPGAYRVTYKVVNSYGESDEKTIEVVVYTKPTITAHDVAIKKGLAFDPLNYEPIGLKATDPIDGDITDKITVKFNNVDTSKPGKYHVTYKVINSYEKIDEKTIEVTVYTKPTIVAQDVKIKKDTAFDPLNYEPIGLKATDPIDGDITDKITVEFNDVDTSKPGAYSVRYKVVNNYEESDEKTIAVTVPVIDDGWENGDPTGWKFFSGETITLEEDEENALNGKWVFYADKHVAIYKQVELKNNTPYQITVYVKPEDEETVAHHIVKVSFKSDSAGQESEEIINERLIDAEQIQKGYRKLTSIPFTPTTIVPNKKPVIIVENFLPGWIGGVRIIVEPTK

SEQ ID NO: 140 - protein, 632 aa, Artificial sequence; identical to SEQ ID NO: 139
  variant of native sequence

SEQ ID NO: 141 - protein, 632 aa, Unknown
  Bacillus sp. obtained from an environmental sample
LNSKSIIENEVQENQYIDIRNICSINGSAKFDPNTNITTLTEAINSQAGAIAGKTALDMRRDFTLVADIYLGSKSSGADGIAIAFHRGSIGFIGTMGGGLGILGAPNGIGFEIDTYWKASSDETGDSFGHGQMNGPHAGFVSTNRNASYLTALAPMQRIPAPNDKWRVLTINWDARNNKLTASLQEKNNDASTRSATPRYQAWELLNPAFDLNQKYTFVIGSATGAANNKHQIGVTLFEAYFTKPTIVANPVDIEIGTAFDPLKYEPIGLKATDEVDGDITKDITVEFNDVDTSKPGAYRVTYKVVNSYGESDEKTIEVVVYTKPTITAHDVAIKKGLAFDPLNYEPIGLKATDPIDGDITDKITVKFNNVDTSKPGKYHVTYKVINSYEKIDEKTIEITVYTKPTIVAQDVKIKKDTAFDPLNYEPIGLKATDPIDGDITDKITVEFNDVDTSKPGAYSVRYKVVNNYEESDEKTIAVTVPVIDDGWENGDPTGWKFFSGETITLEEDEENALNGKWVFYADKHVAIYKQVELKNNTPYQITVYVKPEDEETVAHHIVKVSFKSDSAGQESEEIINERLIDAEQIQKGYRKLTSIPFTPTTIVPNKKPVIIVENFLPGWIGGVRIIVEPTK

SEQ ID NO: 142 - protein, 632 aa, Artificial sequence
  variant of native sequence
MNSKSIIENEVQENQYIDIRNICSINGSAKFDPNTNITTLTEAINSQAGAIAGKTALDMRRDFTLVADIYLGSKSSGADGIAIAFHRGSIGFIGTMGGGLGILGAPNGIGFEIDTYWKASSDETGDSFGHGQMNGPHAGFVSTNRNASYLTALAPMQRIPAPNDKWRVLTINWDARNNKLTASLQEKNNDASTRSATPRYQAWELLNPAFDLNQKYTFVIGSATGAANNKHQIGVTLFEAYFTKPTIVANPVDIEIGTAFDPLKYEPIGLKATDEVDGDITKDITVEFNDVDTSKPGAYRVTYKVVNSYGESDEKTIEVVVYTKPTITAHDVAIKKGLAFDPLNYEPIGLKATDPIDGDITDKITVKFNNVDTSKPGKYHVTYKVINSYEKIDEKTIEITVYTKPTIVAQDVKIKKDTAFDPLNYEPIGLKATDPIDGDITDKITVEFNDVDTSKPGAYSVRYKVVNNYEESDEKTIAVTVPVIDDGWENGDPTGWKFFSGETITLEEDEENALNGKWVFYADKHVAIYKQVELKNNTPYQITVYVKPEDEETVAHHIVKVSFKSDSAGQESEEIINERLIDAEQIQKGYRKLTSIPFTPTTIVPNKKPVIIVENFLPGWIGGVRIIVEPTK

SEQ ID NO: 143 - protein, 472 aa, Unknown
  Bacillus sp. obtained from an environmental sample
LNSKSITEKEIQENQYIDIRNICSINGSAKFDPNTNITTLTEAINSQAGAIAGKTALDMKRDFTLVADIYLGSKSSGADGIAIAFHRGSIGFIGTMGGGLGILGAPNGIGFEIDTYWKATSDETGDSFGHGQMNGAHAGFVSTNRNASYLTALAPMQKIPEPNNKWRVLTINWDARNNKLTARLQEKSNDASTSTPSPRYQTWELLNPAFDLNQKYTFIIGSATGAANNEHQIGVTLFEAYFTKPTIEANPVDIELGTAFDPLNYEPIGLKATDSIDGDITDKITVEYNDVDTSKPGAYSVKYKVVNNYEESDEKTIAVTVPVIDDGWENGDPTGWKFFSGETITLEEDEENALNGKWVFYADKHVAIYKQVELKNNIPYQITVYVKPEDEGTVAHHIVKVSFKSDSAGPENEEVINERLIDAEQIQKGYRKLTSMPFTPTTIVPNKKPVIIVENFLPGWIGGVRIIVEPTK

SEQ ID NO: 144 - protein, 472 aa, Artificial sequence
  variant of native sequence
MNSKSITEKEIQENQYIDIRNICSINGSAKFDPNTNITTLTEAINSQAGAIAGKTALDMKRDFTLVADIYLGSKSSGADGIAIAFHRGSIGFIGTMGGGLGILGAPNGIGFEIDTYWKATSDETGDSFGHGQMNGAHAGFVSTNRNASYLTALAPMQKIPEPNNKWRVLTINWDARNNKLTARLQEKSNDASTSTPSPRYQTWELLNPAFDLNQKYTFIIGSATGAANNEHQIGVTLFEAYFTKPTIEANPVDIELGTAFDPLNYEPIGLKATDSIDGDITDKITVEYNDVDTSKPGAYSVKYKVVNNYEESDEKTIAVTVPVIDDGWENGDPTGWKFFSGETITLEEDEENALNGKWVFYADKHVAIYKQVELKNNIPYQITVYVKPEDEGTVAHHIVKVSFKSDSAGPENEEVINERLIDAEQIQKGYRKLTSMPFTPTTIVPNKKPVIIVENFLPGWIGGVRIIVEPTK

SEQ ID NO: 145 - protein, 632 aa, Unknown
  Bacillus sp. obtained from an environmental sample
LNSKSIIEKGVQENQYIDIRNICSINGSAKFDPNTNVTTLTEAINSQAGAIAGKTALDMRRDFTLVADIYLGSNSSGADGIAIAFHRGSIGFIGTMGGGLGILGAPNGIGFEIDTYWKATSDETGDSFGHSQMNGAHAGFVSTNRNASYLTALAPMQKIPAPNNKWRVLTINWDARNNKLTARLQEKSNDASTSTPSPRYQTWELLNPSFDLNQKYTFIIGSATGAANNKHQIGVTLFEAYFTKPTIEANPVDIELGTAFDPLNYEPIGLKATDEVDGDITKDITVEFNDVDTSKPGAYRVTYKVVNSYGESDEKTIEVVVYTKPTITAHDIAIKKDLAFDPLNYEPIGLKATDPIDGDITDKIAVKFNNVDTSKPGKYHVTYKVINSYEKIDEKTIEVIVYTKPSIVAHDVEIKKDTAFDPLNYEPIGLKATDPIDGDITDKITVESNDVDTSIPGAYSVKYKVVNNYEESDEKTIAVTVPVIDDGWENGDPTGWKFFSGETITLEEDEENALNGKWVFYADKHVAIYKQVELKNNIPYQITVYVKPEDEGTVAHHIVKVSFKSDSAGPENEEVINERLIDAEQIQKGYRKLTSMPFTPTTIVPNKKPVIIVENFLPGWIGGVRIIVEPTK

SEQ ID NO: 146 - protein, 632 aa, Artificial sequence
  variant of native sequence
MNSKSIIEKGVQENQYIDIRNICSINGSAKFDPNTNVTTLTEAINSQAGAIAGKTALDMRRDFTLVADIYLGSNSSGADGIAIAFHRGSIGFIGTMGGGLGILGAPNGIGFEIDTYWKATSDETGDSFGHSQMNGAHAGFVSTNRNASYLTALAPMQKIPAPNNKWRVLTINWDARNNKLTARLQEKSNDASTSTPSPRYQTWELLNPSFDLNQKYTFIIGSATGAANNKHQIGVTLFEAYFTKPTIEANPVDIELGTAFDPLNYEPIGLKATDEVDGDITKDITVEFNDVDTSKPGAYRVTYKVVNSYGESDEKTIEVVVYTKPTITAHDIAIKKDLAFDPLNYEPIGLKATDPIDGDITDKIAVKFNNVDTSKPGKYHVTYKVINSYEKIDEKTIEVIVYTKPSIVAHDVEIKKDTAFDPLNYEPIGLKATDPIDGDITDKITVESNDVDTSIPGAYSVKYKVVNNYEESDEKTIAVTVPVIDDGWENGDPTGWKFFSGETITLEEDEENALNGKWVFYADKHVAIYKQVELKNNIPYQITVYVKPEDEGTVAHHIVKVSFKSDSAGPENEEVINERLIDAEQIQKGYRKLTSMPFTPTTIVPNKKPVIIVENFLPGWIGGVRIIVEPTK

SEQ ID NO: 147 - protein, 632 aa, Unknown
  Bacillus sp. obtained from an environmental sample
LNSKSIIENEVQENQYIDIRNICSINGSAKFDPNTNITTLTEAINSQAGAIAGKTALDMRRDFTLVADIYLGSKSSGADGIAIAFHRGSIGFIGTMGGGLGILGAPNGIGFEIDTYWKASSDETGDSFGHGQMNGPHAGFVSTDRKASYLTALAPMQRIAPPNGQWRVLTIKWDARDNKLTASLQEKNNDASTRSATPRYQTWELLNPAFDLNQKYTFVIGSATGAANNKHQIGVTLFEAYFTKPTIVANPVDIEIGTAFDPLNYEPIGLKATDEVDGDITKDITVEFNDVDTSKPGAYRVTYKVVNSYGESDEKTIEVVVYTKPTITAHDVAIKKGLAFDPLNYEPIGLKATDPIDGDITDKITVKFNNVDTSKPGKYHVTYKVINSYEKIDEKTIEVTVYTKPTIVAQDVKIKKDTAFDPLNYEPIGLKATDPIDGDITDKITVEFNDVDTSKPGAYSVRYKVVNNYEKSDEKTIAVTVPVIDDGWENGDPTGWKFFSGETITLEEDEENALNGKWVFYADKHVAIYKQVELKNNTPYQITVYVKPEDEETVAHHIVKVSFKSDSAGQESEEIINERLIDAEQIQKGYRKLTSIPFTPTTIVPNKKPVIIVENFLPGWIGGVRIIVEPTK

SEQ ID NO: 148 - protein, 632 aa, Artificial sequence
  variant of native sequence
MNSKSIIENEVQENQYIDIRNICSINGSAKFDPNTNITTLTEAINSQAGAIAGKTALDMRRDFTLVADIYLGSKSSGADGIAIAFHRGSIGFIGTMGGGLGILGAPNGIGFEIDTYWKASSDETGDSFGHGQMNGPHAGFVSTDRKASYLTALAPMQRIAPPNGQWRVLTIKWDARDNKLTASLQEKNNDASTRSATPRYQTWELLNPAFDLNQKYTFVIGSATGAANNKHQIGVTLFEAYFTKPTIVANPVDIEIGTAFDPLNYEPIGLKATDEVDGDITKDITVEFNDVDTSKPGAYRVTYKVVNSYGESDEKTIEVVVYTKPTITAHDVAIKKGLAFDPLNYEPIGLKATDPIDGDITDKITVKFNNVDTSKPGKYHVTYKVINSYEKIDEKTIEVTVYTKPTIVAQDVKIKKDTAFDPLNYEPIGLKATDPIDGDITDKITVEFNDVDTSKPGAYSVRYKVVNNYEKSDEKTIAVTVPVIDDGWENGDPTGWKFFSGETITLEEDEENALNGKWVFYADKHVAIYKQVELKNNTPYQITVYVKPEDEETVAHHIVKVSFKSDSAGQESEEIINERLIDAEQIQKGYRKLTSIPFTPTTIVPNKKPVIIVENFLPGWIGGVRIIVEPTK

SEQ ID NO: 149 - protein, 641 aa, Unknown
  Bacillus sp. obtained from an environmental sample
MKGRRPMGNMDSKSVMEKKEQKSQYLDIRDICSINGSAKFDPNTNITTLTEAINSQAGAIAGKTAFDMRHDFTLVADIYLGSKSSGADGIAIAFHRGSIGFIGQMGGGLGILGAPNGIGFEIDTYWKASSDETGDSFGHGQMNGPHAGFVSTNRNTSYLTALAPMQRIPAPNSKWRILTINWDARNNKLTARLQEKNNDDTTRSASPRYQTWELLNPAFDLNQKYTFVIGSATGAANNKHQIGVTLFEAYFTKPTIEANPVDIEIGTAFDPLKYELIGLKATDEIDGDITDKITVEFNNVDTSKPGAYRVTYKVLNSYEESDEKTIEVVVYTKPTIAAHDVAIKKDLAFDPLDYEPIELKATDPIDGDITDKITIESNNADTSKPGKYHVTYKVLNSYEKSDEKTIEITVYTKPTLEAYDVEIKKDTVFDPLNYEPIGLKATDPIDGDITDKITVESNNVDTSKPGEYHVTYKVLNSYEESDEKTITVMVPVIDDGWENGDPNGWKFFSGESITLEEDEENALNGKWVFYSDKHVAIYKQVELENNISYQITVYVKPEDEGTVANHIVKVSLKPDPASGESQEILNTRLLGAEQIQKGYRKLTSNPFIPTTIEPYKKPIIVIENFLAGWIGGIKIIVEPTK

SEQ ID NO: 150 - protein, 632 aa, Artificial sequence
  variant of native sequence
MDSKSVMEKKEQKSQYLDIRDICSINGSAKFDPNTNITTLTEAINSQAGAIAGKTAFDMRHDFTLVADIYLGSKSSGADGIAIAFHRGSIGFIGQMGGGLGILGAPNGIGFEIDTYWKASSDETGDSFGHGQMNGPHAGFVSTNRNTSYLTALAPMQRIPAPNSKWRILTINWDARNNKLTARLQEKNNDDTTRSASPRYQTWELLNPAFDLNQKYTFVIGSATGAANNKHQIGVTLFEAYFTKPTIEANPVDIEIGTAFDPLKYELIGLKATDEIDGDITDKITVEFNNVDTSKPGAYRVTYKVLNSYEESDEKTIEVVVYTKPTIAAHDVAIKKDLAFDPLDYEPIELKATDPIDGDITDKITIESNNADTSKPGKYHVTYKVLNSYEKSDEKTIEITVYTKPTLEAYDVEIKKDTVFDPLNYEPIGLKATDPIDGDITDKITVESNNVDTSKPGEYHVTYKVLNSYEESDEKTITVMVPVIDDGWENGDPNGWKFFSGESITLEEDEENALNGKWVFYSDKHVAIYKQVELENNISYQITVYVKPEDEGTVANHIVKVSLKPDPASGESQEILNTRLLGAEQIQKGYRKLTSNPFIPTTIEPYKKPIIVIENFLAGWIGGIKIIVEPTK

SEQ ID NO: 151 - protein, 632 aa, Unknown
  Bacillus sp. obtained from an environmental sample
LNSKSIIEKEVQESQYIDIRNICSINGSAKFDPNTNITTLTEAKNSQAGAIAGKTALDMRRDFTLVADIYLGSNSSGADGIAIAFHRGSIGFIGTMGGGLGILGAPNGIGFEIDTYWKATSDETGDSFGHGQMNGAHAGFVSTNRNASYLTALAPMQKIPAPNNKWRVLTINWDARNNKLIASLQEKNNDASTRSATPRYQTWELLNPAFDLKQKYTFIIGSATGAANNKHQIGVTLFEAYFTKPTIVANPVDIELGTAFDPLNYQPIGLKATDEVDGDITKDITVEFNDVDTSKPGPYRVTYKVVNSYGESDEKTIEVVVYTKPTITAHDIAIKKDLAFDPLNYEPIGLKATDPIDGDITDKIAVKFNNVDTSKPGKYHVTYKVINSYEKIDEKTIEVTVYTKPTIVAHDVAIKKDTAFDPLNYEPIGLKATDPIDGDITDKISVESNNVDTSKPGEYQVTYKVINSYGEFDDKTITITVPVIDDGWENGDPQGWKFFSGETITLEEDEENALNGKWVFYADKHVAIYKQVEFKNNTPYQITVYIKPEDEETVAHHNVKVSFKSDSASQESEEILNERLIDAEQIQKGYRKLTSIPFTPTTIAPNKKPVIIVENFLPGWIGGVRIIVEPTK

SEQ ID NO: 152 - protein, 632 aa, Artificial sequence
  variant of native sequence
MNSKSIIEKEVQESQYIDIRNICSINGSAKFDPNTNITTLTEAKNSQAGAIAGKTALDMRRDFTLVADIYLGSNSSGADGIAIAFHRGSIGFIGTMGGGLGILGAPNGIGFEIDTYWKATSDETGDSFGHGQMNGAHAGFVSTNRNASYLTALAPMQKIPAPNNKWRVLTINWDARNNKLIASLQEKNNDASTRSATPRYQTWELLNPAFDLKQKYTFIIGSATGAANNKHQIGVTLFEAYFTKPTIVANPVDIELGTAFDPLNYQPIGLKATDEVDGDITKDITVEFNDVDTSKPGPYRVTYKVVNSYGESDEKTIEVVVYTKPTITAHDIAIKKDLAFDPLNYEPIGLKATDPIDGDITDKIAVKFNNVDTSKPGKYHVTYKVINSYEKIDEKTIEVTVYTKPTIVAHDVAIKKDTAFDPLNYEPIGLKATDPIDGDITDKISVESNNVDTSKPGEYQVTYKVINSYGEFDDKTITITVPVIDDGWENGDPQGWKFFSGETITLEEDEENALNGKWVFYADKHVAIYKQVEFKNNTPYQITVYIKPEDEETVAHHNVKVSFKSDSASQESEEILNERLIDAEQIQKGYRKLTSIPFTPTTIAPNKKPVIIVENFLPGWIGGVRIIVEPTK

SEQ ID NO: 153 - protein, 632 aa, Unknown
  Bacillus sp. obtained from an environmental sample
LNSKSIIENEVQENQYIDIRNICSINGSAKFDPNTNITTLTEAINSQAGAIAGKTALDMRRDFTLVADIYLGSKSSGADGIAIAFHRGSIGFIGTMGGGLGILGAPNGIGFEIDTYWKASSDETGDSFGHGQMNGPHAGFVSTNRNASYLTALAPMQRIPAPNDKWRVLTINWDARNNKLTASLQEKNNDASTRSATPRYQAWELLNPAFDLNQKYTFVIGSATGAANNKHQIGVTLFEAYFTKPTIVANPVDIEIGTAFDPLNYEPIGLKATDEVDGDITKDITVEFNDVDTSKPGAYRVTYKVVNSYGESDEKTIEVVVYTKPTITAHDVAIKKGLAFDPLNYEPIGLKATDPIDGDITDKITVKFNNVDTSKPGKYHVTYKVINSYEKIDEKTIEITVYTKPTIVAQDVKIKKDTAFDPLNYEPIGLKATDPIDGDITDKITVEFNDVDTSKPGAYSVRYKVVNNYEESDEKTIAVTVPVIDDGWENGDPTGWKFFSGETITLEEDEENALNGKWVFYADKHVAIYKQVELKNNTPYQITVYVKPEDEETVAHHIVKVSFKSDSAGQESEEIINERLIDAEQIQKGYRKLTSIPFTPTTIVPNKKPVIIVENFLPGWIGGVRIIVEPTK

SEQ ID NO: 154 - protein, 632 aa, Artificial sequence
  variant of native sequence
MNSKSIIENEVQENQYIDIRNICSINGSAKFDPNTNITTLTEAINSQAGAIAGKTALDMRRDFTLVADIYLGSKSSGADGIAIAFHRGSIGFIGTMGGGLGILGAPNGIGFEIDTYWKASSDETGDSFGHGQMNGPHAGFVSTNRNASYLTALAPMQRIPAPNDKWRVLTINWDARNNKLTASLQEKNNDASTRSATPRYQAWELLNPAFDLNQKYTFVIGSATGAANNKHQIGVTLFEAYFTKPTIVANPVDIEIGTAFDPLNYEPIGLKATDEVDGDITKDITVEFNDVDTSKPGAYRVTYKVVNSYGESDEKTIEVVVYTKPTITAHDVAIKKGLAFDPLNYEPIGLKATDPIDGDITDKITVKFNNVDTSKPGKYHVTYKVINSYEKIDEKTIEITVYTKPTIVAQDVKIKKDTAFDPLNYEPIGLKATDPIDGDITDKITVEFNDVDTSKPGAYSVRYKVVNNYEESDEKTIAVTVPVIDDGWENGDPTGWKFFSGETITLEEDEENALNGKWVFYADKHVAIYKQVELKNNTPYQITVYVKPEDEETVAHHIVKVSFKSDSAGQESEEIINERLIDAEQIQKGYRKLTSIPFTPTTIVPNKKPVIIVENFLPGWIGGVRIIVEPTK

SEQ ID NO: 155 - protein, 632 aa, Unknown
  Bacillus sp. obtained from an environmental sample
MNSKSTIEKEVQKSQYLDIRNICSINGSAKFDPNTNITTLTEAINSQAGAIAGKTALDMRHDFTLVADIFLGSKSSGADGIAITFHRGSIGFIGNMGGGLGILGAPNGIGFEIDTYWKASSDETGDSFGHGQMNGPHAGFVSTNRNASYLTALAPMQRIPAPNGKWRVLTINWDARNNKLTARLQEKSNDASTSSPSPRYQTWELLNPAFDLNQKYTFVIGSATGAANNKHQIGITLFEAYFTKPTIEANPVDIEIGTAFDPLNYEPIGLKATDEIDGDITDKITVGFNDVDTSKPGAYRVTYKVVNSYEESDEKTIEVIVYTKPTITAHDVVIKKDLAFDPLNYEPIGLKAIDPIDGDITDKVTVESNNVDTSKPGKYHVAYKVVNSYEKSDEKTIEVVVYTKPTLEAHDVEIKKDTVFDPLNYEPIGLKATDPIDGDITDKITVESDNVDTSKPGEYHVTYKVVNSYEESDEKSILVTVPVIDDGWENGDPKGWKFFSGESITLDEDEENALNGKWVFSSDKHVAIYKQVELENNTTYQITVYVKPEDEGTVAHHIVKASLKPDPSGPDSEELLNERLINGEQIQKGYRKLTSIPFTPTTIEPYKKPLIVIENYLAGWIGGIKIIVEPTK

SEQ ID NO: 156 - protein, 632 aa, Unknown
  Bacillus sp. obtained from an environmental sample
LNSKSIIEKGVQENQYIDIRNICSINGSAKFDPNTNVTTLTEAINSQAGAIAGKTALDMRRDFTLVADIYLGSNSSGADGIAIAFHRGSIGFIGTMGGGLGILGAPNGIGFEIDTYWKATSDETGDSFGHGQMNGAHAGFVSTNRNASYLTALAPMQKIPAPNNKWRVLTINWDARNNKLTARLQEKSNDASTSTPSPSYQTWELLNPAFDLNQKYTFIIGSATGAANNKHQIGVTLFEAYFTKPTIEANPVDIELGTAFDPLNYEPIGLKATDEVDGDITKDITVEFNDVDTSKPGAYRVIYKVVNSYGESDEKTIEVVVYTKPTITAHDIAIKKDLAFDPLNYEPIGLKATDPIDGDITDKIAVKFNNVDTSKPGKYHVTYKVINSYEKIDEKTIEVTVYTKPSIVAHDVEIKKDTAFDPLNYEPIGLKATDPIDGDITDKITVESNDVDTSKPGAYSVKYKVVNNYEECDEKTIAVTVPVIDDGWENGDPTGWKFFSGETITLEEDEENALNGKWVFYADKHVAIYKQVELKNNIPYQITVYVKPEDEGTVAHHIVKVSFKSDSASPESEEVINERLIDAEQIRKGYRQLTSIPFTPTTIVPNKKPVIIVENFLPGWIGGVRIIIEPTK

SEQ ID NO: 157 - protein, 632 aa, Artificial sequence
  variant of native sequence
MNSKSIIEKGVQENQYIDIRNICSINGSAKFDPNTNVTTLTEAINSQAGAIAGKTALDMRRDFTLVADIYLGSNSSGADGIAIAFHRGSIGFIGTMGGGLGILGAPNGIGFEIDTYWKATSDETGDSFGHGQMNGAHAGFVSTNRNASYLTALAPMQKIPAPNNKWRVLTINWDARNNKLTARLQEKSNDASTSTPSPSYQTWELLNPAFDLNQKYTFIIGSATGAANNKHQIGVTLFEAYFTKPTIEANPVDIELGTAFDPLNYEPIGLKATDEVDGDITKDITVEFNDVDTSKPGAYRVIYKVVNSYGESDEKTIEVVVYTKPTITAHDIAIKKDLAFDPLNYEPIGLKATDPIDGDITDKIAVKFNNVDTSKPGKYHVTYKVINSYEKIDEKTIEVTVYTKPSIVAHDVEIKKDTAFDPLNYEPIGLKATDPIDGDITDKITVESNDVDTSKPGAYSVKYKVVNNYEECDEKTIAVTVPVIDDGWENGDPTGWKFFSGETITLEEDEENALNGKWVFYADKHVAIYKQVELKNNIPYQITVYVKPEDEGTVAHHIVKVSFKSDSASPESEEVINERLIDAEQIRKGYRQLTSIPFTPTTIVPNKKPVIIVENFLPGWIGGVRIIIEPTK

SEQ ID NO: 158 - protein, 632 aa, Unknown
  Bacillus sp. obtained from an environmental sample
LNSKSIIEKGVQENQYIDIRNICSINGSAKFDPNTNITTLTEAINSQAGAIAGKTALDMRRDFTLVADIYLGSKSSGADGIAIAFHRGSIGFIGTMGGGLGILGAPNGIGFEIDTYWKATSDETGDSFGHGQMNGAHAGFVSTNQNASYLTALAPMQKIPAPNNKWRVLTINWDARNNKLTARLQEKSNDASTRTPSPRYQTWELLNPAFDLNQKYTFIIGSATGAANNKHQIGVTLFEAYFTKPTIEANPVDIELGTAFDPLNYEPIGLKATDEVDGDITKDITVEFNDVDTSKPGAYRVTYKVVNSYGESDEKTIEVVVYTKPTITAHDIAIKKDLTFDPLNYEPIGLKATDPIDGDITDKITVKFNNVDTSKPGKYHITYKVVNSYEKIEEKTIEITVYTKPSIEAYDVEIKKDTAFDPLNYEPIGLKATDPIDGDITDKITVESNDVDTSKPGAYSVKYKVVNNYEESDEKTIAVTVPVIDDGWENGDPTGWKFFSGETITLEEDEENALNGKWVFYADKHVAIYKQVELKNNTPYQITVYVKPEDEGTVAHHIVKVSFKSDSAGQESEEIINKRLIDAEQIQKGYRKLASIPFTPTTIVPNKKPVIIVENFLPGWIGGVRVIVEPTK

SEQ ID NO: 159 - protein, 632 aa, Artificial sequence
  variant of native sequence
MNSKSIIEKGVQENQYIDIRNICSINGSAKFDPNTNITTLTEAINSQAGAIAGKTALDMRRDFTLVADIYLGSKSSGADGIAIAFHRGSIGFIGTMGGGLGILGAPNGIGFEIDTYWKATSDETGDSFGHGQMNGAHAGFVSTNQNASYLTALAPMQKIPAPNNKWRVLTINWDARNNKLTARLQEKSNDASTRTPSPRYQTWELLNPAFDLNQKYTFIIGSATGAANNKHQIGVTLFEAYFTKPTIEANPVDIELGTAFDPLNYEPIGLKATDEVDGDITKDITVEFNDVDTSKPGAYRVTYKVVNSYGESDEKTIEVVVYTKPTITAHDIAIKKDLTFDPLNYEPIGLKATDPIDGDITDKITVKFNNVDTSKPGKYHITYKVVNSYEKIEEKTIEITVYTKPSIEAYDVEIKKDTAFDPLNYEPIGLKATDPIDGDITDKITVESNDVDTSKPGAYSVKYKVVNNYEESDEKTIAVTVPVIDDGWENGDPTGWKFFSGETITLEEDEENALNGKWVFYADKHVAIYKQVELKNNTPYQITVYVKPEDEGTVAHHIVKVSFKSDSAGQESEEIINKRLIDAEQIQKGYRKLASIPFTPTTIVPNKKPVIIVENFLPGWIGGVRVIVEPTK

SEQ ID NO: 160 - protein, 632 aa, Bacillus thuringiensis
LNSKSIIEKGVQENQYIDIRNICSINGSAKFDPNTNITTLTEAINSQAGAIAGKTALDMRRDFTLVADIYLGSKSSGADGIAIAFHRGSIGFIGTMGGGLGILGAPNGIGFEIDTYWKATSDETGDSFGHGQMNGAHAGFVSTNRNASYLTALAPMQKIPAPNNKWRVLTINWDARNNKLTARLQEKSNDASTSTPSPRYQTWELLNPAFDLNQKYTFIIGSATGAANNKHQIGVTLFEAYFTKPTIEANPVDIELGTAFDPLNHEPIGLKATDEVDGDITKDITVEFNDIDTSKPGAYRVTYKVVNSYGESDEKTIEVVVYTKPTITAHDITIKKDLAFDPLNYEPIGLKATDPIDGDITDKIAVKFNNVDTSKPGKYHVTYKVINSYEKIDEKTIEVTVYTKPSIVAHDVEIKKDTAFDPLNYEPIGLKATDPIDGDITDKITVESNDVDTSKPGAYSVKYKVVNNYEESDEKTIAVTVPVIDDGWENGDPTGWKFFSGETITLEDDEEHALNGKWVFYADKHVAIYKQVELKNNIPYQITVYVKPEDEGTVAHHIVKVSFKSDSAGPESEEVINERLIDAEQIQKGYRKLTSIPFTPTTIVPNKKPVIIVENFLPGWIGGVRIIVEPTK

SEQ ID NO: 161 - protein, 15 aa, Artificial sequence
  consensus sequence
ICSINGSAKFDPNTN

SEQ ID NO: 162 - protein, 12 aa, Artificial sequence
  consensus sequence
NSQAGAIAGKTA

SEQ ID NO: 163 - protein, 10 aa, Artificial sequence
  consensus sequence
IGSATGAANN

SEQ ID NO: 164 - protein, 13 aa, Artificial sequence
  consensus sequence
PLNYEPIGLKATD

SEQ ID NO: 165 - protein, 13 aa, Artificial sequence
  consensus sequence
VPVIDDGWENGDP

SEQ ID NO: 166 - protein, 13 aa, Artificial sequence
  consensus sequence
EDEENALNGKWVF

SEQ ID NO: 167 - protein, 11 aa, Artificial sequence
  consensus sequence
DKHVAIYKQVE

That which is claimed is:

1. A recombinant polypeptide, comprising
   a polypeptide comprising an amino acid sequence having at least 95% sequence identity to the amino acid sequence as set forth in SEQ ID NO: 36, wherein said polypeptide has pesticidal activity and further comprises a heterologous amino acid sequence chemically linked to said polypeptide.

2. A composition comprising the polypeptide of claim 1.

3. A recombinant nucleic acid molecule encoding an amino acid sequence comprising
   at least 95% sequence identity to the amino acid sequence as set forth in SEQ ID NO:36.

4. The recombinant nucleic acid of claim 3, wherein said nucleic acid molecule is a synthetic sequence designed for expression in a plant.

5. The recombinant nucleic acid molecule of claim 3, wherein said heterologous promoter is capable of directing expression in a plant cell.

6. The recombinant nucleic acid molecule of claim 3, wherein said heterologous promoter is capable of directing expression in a bacteria.

7. A host cell comprising the recombinant nucleic acid molecule of claim 3.

8. The host cell of claim 7, wherein said host cell is a bacterial host cell.

9. A DNA construct comprising a heterologous promoter that drives expression in a plant cell operably linked to a nucleotide sequence that encodes
a polypeptide comprising the amino acid sequence having at least 95% sequence identity to an amino acid sequence as set forth in SEQ ID NO:36.

10. The DNA construct of claim 9, wherein said nucleotide sequence is a synthetic DNA sequence designed for expression in a plant.

11. A vector comprising the DNA construct of claim 9.

12. A host cell comprising the DNA construct of claim 11.

13. A composition comprising the host cell of claim 12.

14. The composition of claim 13, wherein said composition is selected from the group consisting of a powder, dust, pellet, granule, spray, emulsion, colloid, and solution.

15. The composition of claim 14, wherein said composition comprises from about 1% to about 99% by weight of said polypeptide.

16. A method for controlling a pest population comprising contacting said pest population with a pesticidal-effective amount of the composition of claim 2.

17. A method for producing a polypeptide with pesticidal activity comprising culturing the host cell of claim 12 under conditions in which the nucleic acid molecule encoding the polypeptide is expressed.

18. A plant having stably incorporated into its genome a DNA construct comprising
a nucleotide sequence that encodes a polypeptide comprising an amino acid sequence having at least 95% sequence identity to the amino acid sequence as set forth in SEQ ID NO:36, wherein said polypeptide has pesticidal activity.

19. A transgenic seed of the plant of claim 18.

20. A method for protecting a plant from an insect pest, comprising expressing in a plant or cell thereof
a nucleotide sequence that encodes a polypeptide comprising an amino acid sequence having at least 95% sequence identity to the amino acid sequence as set forth in SEQ ID NO:36, wherein said nucleotide sequence encodes a polypeptide having pesticidal activity and is operably linked to a promoter capable of driving expression in the plant or cell.

21. The method of claim 20, wherein said plant produces a pesticidal polypeptide having pesticidal activity against a Hemipteran pest.

22. The recombinant polypeptide of claim 1, wherein the polypeptide comprises an amino acid sequence having at least 90% sequence identity to the amino acid sequence set forth in SEQ ID NO: 35.

23. A composition comprising the polypeptide of claim 22.

24. The recombinant nucleic acid molecule of claim 3, wherein the recombinant nucleic acid molecule encodes an amino acid sequence having at least 90% sequence identity to the amino acid sequence set forth in SEQ ID NO: 35.

25. A host cell comprising the recombinant nucleic acid molecule of claim 24.

26. The DNA construct of claim 9, wherein the nucleotide sequence encodes an amino acid sequence having at least 90% sequence identity to the amino acid sequence set forth in SEQ ID NO: 35.

27. A vector comprising the DNA construct of claim 26.

28. A host cell comprising the DNA construct of claim 26.

29. A composition comprising the host cell of claim 28.

30. The plant of claim 18, wherein the nucleotide sequence encodes a polypeptide comprising an amino acid sequence having at least 90% sequence identity to the amino acid sequence set forth in SEQ ID NO: 35.

31. A transgenic seed of the plant of claim 30.

32. A method for controlling a pest population comprising contacting said pest population with a pesticidal-effective amount of the composition of claim 23.

33. A method for producing a polypeptide with pesticidal activity comprising culturing the host cell of claim 25 under conditions in which the nucleic acid molecule encoding the polypeptide is expressed.

34. The method of claim 20, wherein the nucleotide sequence encodes a polypeptide comprises an amino acid sequence having at least 90% sequence identity to the amino acid sequence set forth in SEQ ID NO: 35.

35. The recombinant polypeptide of claim 1, wherein the polypeptide comprises the amino acid sequence set forth in SEQ ID NO:36.

36. The recombinant nucleic acid molecule of claim 3, wherein the nucleic acid molecule encodes the amino acid sequence set forth in SEQ ID NO:36.

37. The DNA construct of claim 9, wherein the nucleotide sequence encodes a polypeptide comprising the amino acid sequence set forth in SEQ ID NO:36.

38. The plant of claim 18, wherein the DNA construct comprises a nucleotide sequence that encodes a polypeptide comprising the amino acid sequence of SEQ ID NO:36.

39. The method of claim 20, wherein said nucleotide sequence encodes a polypeptide comprising the amino acid sequence of SEQ ID NO:36.

* * * * *